(12) United States Patent
Lee et al.

(10) Patent No.: US 10,351,849 B2
(45) Date of Patent: Jul. 16, 2019

(54) PHARMACEUTICAL COMPOSITION FOR TREATING CANCER COMPRISING MICRORNA AS ACTIVE INGREDIENT

(71) Applicant: BIONEER CORPORATION, Daejeon (KR)

(72) Inventors: Taewoo Lee, Seoul (KR); Sanghyung Shim, Daejeon (KR); Ungsik Yu, Daejeon (KR); Han Oh Park, Daejeon (KR)

(73) Assignee: BIONEER CORPORATION, Daejeon (KR)

( * ) Notice: Subject to any disclaimer, the term of this patent is extended or adjusted under 35 U.S.C. 154(b) by 0 days.

(21) Appl. No.: 15/553,097

(22) PCT Filed: Feb. 25, 2016

(86) PCT No.: PCT/KR2016/001828
§ 371 (c)(1),
(2) Date: Aug. 23, 2017

(87) PCT Pub. No.: WO2016/137235
PCT Pub. Date: Sep. 1, 2016

(65) Prior Publication Data
US 2018/0030440 A1 Feb. 1, 2018

(30) Foreign Application Priority Data
Feb. 25, 2015 (KR) .................. 10-2015-0026557

(51) Int. Cl.
*A61K 48/00* (2006.01)
*C12N 15/113* (2010.01)
*A61K 31/7105* (2006.01)
*A61K 31/713* (2006.01)
*A61P 35/00* (2006.01)

(52) U.S. Cl.
CPC .......... *C12N 15/113* (2013.01); *A61K 31/713* (2013.01); *A61K 31/7105* (2013.01); *A61K 48/00* (2013.01); *A61P 35/00* (2018.01); *C12N 15/1138* (2013.01); *C12N 2310/141* (2013.01)

(58) Field of Classification Search
None
See application file for complete search history.

(56) References Cited

U.S. PATENT DOCUMENTS

| | | |
|---|---|---|
| 2009/0227533 A1 | 9/2009 | Bader et al. |
| 2012/0302626 A1 | 11/2012 | Sandeep et al. |
| 2014/0080894 A1 | 3/2014 | Mcelligott |

FOREIGN PATENT DOCUMENTS

| | | |
|---|---|---|
| RU | 2476239 C2 | 2/2013 |
| WO | WO2014048441 A1 | 4/2014 |
| WO | 2014100252 A1 | 6/2014 |
| WO | WO2014078686 A1 | 5/2018 |

OTHER PUBLICATIONS

MiRBase Accession No. MI0015071 (original submission Aug. 2011, retrieved from www-mirbase.org May 29, 2018). (Year: 2011).*
Tanji, C., et al., "A-Kinase Anchoring Protein AKAP220 Binds to Glycogen Synthase Kinase-3b (GSK-3b) and Mediates Protein Kinase A-dependent Inhibition of GSK-3b", "The Journal of Biological Chemistry", Oct. 4, 2002, pp. 36955-36961, vol. 277, No. 40.
Tennakoon, S., et al., "The calcium-sensing receptor and the hallmarks of cancer", "Biochimica et Biophysica Acta", 2015, Page(s) http://dx.doi.org/10.1016/j.bbamcr.2015.11.017.
Tomari, Y., et al., "Perspective: machines for RNAi", "Genes & Development", 2005, pp. 517-529, vol. 19.
Ueno, K., et al., "Tumor Suppressor MicroRNA-493 Decreases Cell Motility and Migration Ability in Human Bladder Cancer Cells by Downregulating RhoC and FZD4", "Molecular Cancer Therapeutics", Jan. 2012, pp. 244-253, vol. 11, No. 1.
Van Rooij, E., et al., "Developing MicroRNA Therapeutics", "Circulation Research", 2012, pp. 496-507, vol. 110.
Venere, M., et al., "The mitotic kinesin KIF11 is a driver of invasion, proliferation, and self-renewal in glioblastoma", "Science Translational Medicine", Sep. 9, 2015, pp. 1-13; DOI: 10.1126/scitranslmed.aac6762, vol. 7, No. 304.
Whiting, J. L., et al., "Protein Kinase A Opposes the Phosphorylation-dependent Recruitment of Glycogen Synthase Kinase 3b to A-kinase Anchoring Protein 220", "The Journal of Biological Chemistry", Aug. 7, 2015, pp. 19445-19457, vol. 290, No. 32.
Wiggins, J. F., et al., "Development of a Lung Cancer Therapeutic Based on the Tumor Suppressor MicroRNA-34", "Cancer Research", Jul. 15, 2010, pp. 5923-5930, vol. 70, No. 14.
Zhang, L., et al., "Development of transcriptomic biomarker signature in human saliva to detect lung cancer", "Cellular and Molecular Life Sciences", Jun. 12, 2012, pp. 3341-3350, vol. 69.
Zhang, Q., et al., "Role of microRNA-30c Targeting ADAM19 in Colorectal Cancer", "PLoS One", Mar. 23, 2015, Page(s) DOI:10.1371/journal.pone.0120698, vol. 10, No. 3.

(Continued)

*Primary Examiner* — J. E. Angell
(74) *Attorney, Agent, or Firm* — Hultquist, PLLC; Steven J. Hultquist

(57) ABSTRACT

The present invention relates to a pharmaceutical composition for treatment of cancer, which comprises, as an active ingredient, one or more miRNAs selected from the group consisting of miR-3670, miR-8078, and miR-4477a. The pharmaceutical composition for treatment of cancer according to the present invention exhibits excellent effects of inhibiting cancer cell proliferation and inducing cancer cell apoptosis. Thus, the pharmaceutical composition of the present invention can be effectively used as an anticancer therapeutic agent.

20 Claims, 3 Drawing Sheets
(2 of 3 Drawing Sheet(s) Filed in Color)
Specification includes a Sequence Listing.

(56) References Cited

OTHER PUBLICATIONS

Zheng, C., et al., "microRNA-195 functions as a tumor suppressor by inhibiting CBX4 in hepatocellular carcinoma", "Oncology Reports", 2015, pp. 1115-1122, vol. 33.
Note: For the non-patent literature citations that no month of publication is indicated, the year of publication is more than 1 year prior to the effective filing date of the present application.
Agostini, M., et al., "miR-34: from bench to bedside", "Oncotarget", Apr. 21, 2014, pp. 872-881, vol. 5, No. 4.
Bartel, D. P., "MicroRNAs: Target Recognition and Regulatory Functions", "Cell", Jan. 23, 2009, pp. 215-233, vol. 136.
Bartolome, R. A., et al., "IL-13 receptor a2 signaling requires a scaffold protein, FAM120A, to activate the FAK and PI3K pathways in colon cancer metastatis", "Cancer Research", 2015, Page(s) DOI: 10.115810008-5472. CN-14/3650.
Brodersen, P., et al., "Revisiting the principles of microRNA target recognition and mode of action", "Nature Reviews", Feb. 2009, pp. 141-148, vol. 10.
Burnett, J. C., et al., "RNA-Based Therapeutics: Current Progress and Future Prospects", "Chemistry & Biology", Jan. 27, 2012, pp. 60-71, vol. 19.
Calin, G. A., et al., "MicroRNA signatures in human cancers", "Nature Reviews", Nov. 2006, pp. 857-866, vol. 6.
Carthew, R. W., et al., "Origins and Mechanisms of miRNAs and siRNAs", "Cell", Feb. 20, 2009, pp. 642-655, vol. 136.
Chang, T.-C., et al., "Transactivation of miR-34a by p53 broadly influences gene expression and promotes apoptosis", "Molecular Cell", Jun. 8, 2007, pp. 745-752, vol. 26, No. 5.
Chu, C.-Y., et al., "Potent RNAi by short RNA triggers", "RNA", Jul. 24, 2008, pp. 1714-1719, vol. 24.
Erez, A., et al., "Sil overexpression in lung cancer characterizes tumors with increased mitotic activity", "Oncogene", Apr. 26, 2004, pp. 5371-5377, vol. 23.
Erez, A., et al., "The SIL Gene Is Essential for Mitotic Entry and Survival of Cancer Cells", "Cancer Research", May 1, 2007, pp. 4022-4027, vol. 67, No. 9.
Fujii, M., et al., "SNIP1 Is a Candidate Modifier of the Transcriptional Activity of c-Myc on E Box-Dependent Target Genes", "Molecular Cell", Dec. 8, 2006, pp. 771-783, vol. 24.
Hermeking, H., "The miR-34 family in cancer and apoptosis", "Cell Death and Differentiation", May 22, 2009, pp. 193-199, vol. 17.
Huang, XD., et al., "Phosphorylation of Dishevelled by Protein Kinase RIPK4 Regulates Wnt Signaling", "Science Express", Jan. 31, 2013, pp. 1-7.
Iorns, E., et al., "Utilizing RNA interference to enhance cancer drug discovery", "Nature Reviews", Jul. 2007, pp. 556-568, vol. 6.
Jackson, A. L., et al., "Expression profiling reveals off-target gene regulation by RNAi", "Nature Biotechnology", Jun. 2003, pp. 635-637, vol. 21, No. 6.
Jackson, A. L., et al., "Position-specific chemical modification of siRNAs reduces off-target transcript silencing", "RNA", 2006, pp. 1197-1205, vol. 12.
Jackson, A. L., et al., "Widespread siRNA off-target transcript silencing mediated by seed region sequence , complementarity", "RNA", 2006, pp. 1179-1187, vol. 12.
Jeon, H.-S., et al., "High expression of SNIP1 correlates with poor prognosis in Non-small cell lung cancer and SNIP1 interferes with the recruitment of HDAC1 to RB in vitro", "Lung Cancer", 2013, pp. 24-30, vol. 82.
Jiao, H.-K., et al., "Prognostic significance of Cbx4 expression and its beneficial effect for transarterial chemoembolization in hepatocellular carcinoma", "Cell Death and Disease", Mar. 12, 2015, pp. 1-9; doi:10.1038/cddis.2015.57, vol. 6, No. e1689.
Kota, J., et al., "Therapeutic microRNA Delivery Suppresses Tumorigenesis in a Murine Liver Cancer Model", "Cell", Jun. 12, 2009, pp. 1005-1017, vol. 137.
Landi D., et al., "Role of variations within microRNA-binding sites in cancer", "Mutagenesis", 2012, pp. 205-210, vol. 27, No. 2.
Laviolette, L. A., et al., "17b-Estradiol upregulates GREB1 and accelerates ovarian tumor progression in vivo", "International Journal of Cancer", 2014, pp. 1072-1084, vol. 135.
Li, M., et al., "MicroRNA-561 Promotes Acetaminophen-Induced Hepatotoxicity in Hepg2 Cells and Primary Human Hepatocytes through Down-Regulation of the Nuclear Receptor Co-Repressor Dosage-Sensitive Sex Reversal Adrenal Hypoplasia Congenital Critical Region on X Chromosome, Gene 1 (DAX-1)", "Drug Metabolism and Disposition", 2014, pp. 44-61; DOI: 10.1124/dmd.113.052670, vol. 42.
Li, Q. et al., "SNIP1: a new activator of HSE signaling pathway", "Molecular and Cellular Biochemistry", Oct. 22, 2011, pp. 16, vol. 362.
Li, Y., et al., "The HECTD3 E3 ubiquitin ligase facilitates cancer cell survival by promoting K63-linked polyubiquitination of caspase-8", "Cell Death and Disease", Nov. 28, 2013, pp. 1-11; doi:10.1038/cddis.2013.464, vol. 4, No. e935.
Li, Y., et al., "The HECTD3 E3 Ubiquitin Ligase Suppresses Cisplatin-Induced Apoptosis via Stabilizing MALT1", "Neoplasia", Jan. 2013, pp. 39-48, vol. 15, No. 1.
Liang, X., et al., "Hypoxia-inducible factor-1 alpha, in association with TWIST2 and SNIP1, is a critical prognostic factor in patients with tongue squamous cell carcinoma", "Oral Oncology", 2011, pp. 92-97, vol. 47.
Lin, Z.-Y., et al., "MicroRNA-224 inhibits progression of human prostate cancer by downregulating TRIB1", "International Journal of Cancer", 2014, pp. 541-550, vol. 135.
Logue, J. S., et al., "AKAP220 Protein Organizes Signaling Elements That Impact Cell Migration", "The Journal of Biological Chemistry", Nov. 11, 2011, pp. 39269-39281, vol. 286, No. 45.
Macfarlane, L.-A., et al., "MicroRNA: Biogenesis, Function and Role in Cancer", "Current Genomics", 2010, pp. 537-561, vol. 11.
Malone, C. D., et al., "Small RNAs as Guardians of the Genome", "Cell", 2009, pp. 656-668, vol. 136.
Martens-De Kemp, S. R., et al., "Functional Genetic Screens Identify Genes Essential for Tumor Cell Survival in Head and Neck and Lung Cancer", "Clinical Cancer Research", Apr. 15, 2013, pp. 1994-2003, vol. 19, No. 8.
Mashidori, T., et al., "Increased alpha-taxilin protein expression is associated with the metastatic and invasive potential of renal cell cancer", "Biomedical Research", 2011, pp. 103-110, vol. 32, No. 2.
Mittal, V., "Improving the Efficiency of RNA Interference in Mammals", "Nature Reviews", May 2004, pp. 355-365, vol. 5.
Nicoloso, M. S., et al., "MicroRNAs the micro steering wheel of tumour metastases", "Nature Reviews", Apr. 2009, pp. 293-302, vol. 9.
Nielsen, C. B., et al., "Determinants of targeting by endogenous and exogenous microRNAs and siRNAs", "RNA", 2007, pp. 1894-1910, vol. 13.
Ohashi, K., et al., "Characteristics of Lung Cancers Harboring NRAS Mutations", "Clinical Cancer Research", Mar. 20, 2013, pp. 2584-2591, vol. 19.
Ohtomo, N., et al., "Expression of -taxilin in hepatocellular carcinoma correlates with growth activity and malignant potential of the tumor", "International Journal of Oncology", 2010, pp. 1417-1423, vol. 37.
Orouji, E., et al., "MAP kinase pathway gene copy alterations in NRAS/BRAF wild-type advanced melanoma", "International Journal of Cancer", Dec. 18, 2015, pp. 2257-2262, vol. 138.
Pecina-Slaus, N., et al., "Wnt signaling transcription factors TCF-1 and LEF-1 are upregulated in malignant astrocytic brain tumors", "Histology and Histopathology", 2014, pp. 1557-1564, vol. 29, No. 12.
Peek, A. S., et al., "Design of active small interfering RNAs", "Current Opinion in Molecular Therapeutics", 2007, pp. 110-118, vol. 9, No. 2.
Rae, J. M., et al., "GREB1 is a Novel Androgen-Regulated Gene Required for Prostate Cancer Growth", "The Prostate", 2006, pp. 886-894, vol. 66.
Reynolds, A., et al., "Rational siRNA design for RNA interference", "Nature Biotechnology", Mar. 2004, pp. 326-330, vol. 22, No. 3.

(56) References Cited

OTHER PUBLICATIONS

Roche, K. C., et al., "Regulation of ATR-dependent pathways by the FHA domain containing protein SNIP1", "Oncogene", 2007, pp. 4523-4530, vol. 26.

Shan, N., et al., "MiR-153 inhibits migration and invasion of human non-small-cell lung cancer by targeting ADAM19", "Biochemical and Biophysical Research Communications", Dec. 2, 2014, pp. 385-391, vol. 456.

Soubeyrand, S., et al., "ERK1/2 regulates hepatocyte Trib1 in response to mitochondrial dysfunction", "Biochimica et Biophysica Acta", Oct. 24, 2013, pp. 3405-3414, vol. 1833.

Tanaka, M., et al., "A Novel RNA-Binding Protein, Ossa/C9orf10, Regulates Activity of Src Kinases to Protect Cell from Oxidative Stress-Induced Apoptosis", "Molecular and Cellular Biology", Jan. 2009, pp. 402-413, vol. 29, No. 2.

Tang, Y., et al., "Rapid induction of apoptosis during Kinesin-5 inhibitor-induced mitotic arrest in HL60 cells", "Cancer Letters", 2011, pp. 15-24, vol. 310.

Liu, D., et al., "Identification of Aberrantly Expressed miRNAs in Gastric Cancer", "Gastroenterology Research and Practice", 2014, pp. 1-9.

Ma, Z., et al., "MicroRNA-34a Inhibits the Proliferation and Promotes the Apoptosis of Non-Small Cell Lung Cancer H1299 Cell Line by Targeting TGF[beta]R2", "Tumor Biology", 2015, pp. 2481-2490, vol. 36.

Dangwal, S., et al., "microRNA Therapeutics in Cardiovascular Disease Models", "Annual Review of Pharmacology and Toxicology", Sep. 17, 2013, p. 10.1-10.19, vol. 54.

\* cited by examiner

PHARMACEUTICAL COMPOSITION FOR TREATING CANCER COMPRISING MICRORNA AS ACTIVE INGREDIENT

CROSS-REFERENCE TO RELATED APPLICATIONS

This application is a U.S. national phase under the provisions of 35 U.S.C. § 371 of International Patent Application No. PCT/KR2016/001828 filed Feb. 25, 2016, which in turn claims priority of Korean Patent Application No. 10-2015-0026557 filed Feb. 25, 2015. The disclosures of such international patent application and Korean priority patent application are hereby incorporated herein by reference in their respective entireties, for all purposes.

TECHNICAL FIELD

The present invention relates to an anticancer pharmaceutical composition comprising double-stranded miRNA as an active ingredient. More specifically, the present invention relates to an anticancer pharmaceutical composition comprising, as pharmaceutically active ingredient, miR-3670, miR-8078, or miR-4477a which is capable of effectively inhibiting cancer cell proliferation or inducing cancer cell apoptosis, together with a pharmaceutically acceptable carrier.

BACKGROUND ART

As effective and traditional methods for treating diseases caused by uncontrolled gene control, particularly diseases referred to as cancers, methods of removing tumors by surgical excision have been used. However, where primary cancer is metastasized to other organs, surgical excision is impossible and anticancer chemotherapies have been used. As anticancer agents for chemotherapy, monomolecular compounds synthesized by organic or inorganic methods have been mainly used. Such anticancer drugs have been developed and used against cancer diseases in order mainly to effectively target proteins that disturb signaling pathways by overexpression of phosphorylation proteins included in signaling pathways, thereby inhibiting the activity of the proteins. Such traditional chemotherapies may cause many side effects, because anticancer drugs used are artificially synthesized foreign substances and target already overexpressed proteins.

The development of therapeutic drugs to replace the traditional chemotherapies has been attempted in various ways. One of such attempts is the use of small interfering RNA (hereinafter referred to as siRNA) (Iorns, E., Lord, C. J., Turner, N. & Ashworth, A. Utilizing RNA interference to enhance cancer drug discovery. Nat Rev Drug Discov 6, 556-68. 2007). siRNA is a single-stranded RNA consisting of 16 to 27 nucleotides and serves as one component of a ribonucleoprotein complex known as an RNA Induced Silencing Complex (RISC) in cells (Tomari, Y. & Zamore, P. D. Perspective: machines for RNAi. Genes Dev 19, 517-29, 2005, Chu, C. Y. & Rana, T. M. Potent RNAi by short RNA triggers. Rna 14, 1714-9, 2008, Mittal, V. Improving the efficiency of RNA interference in mammals. Nat Rev Genet 5, 355-65, 2004, Reynolds, A. et al. Rational siRNA design for RNA interference. Nat Biotechnol 22, 326-30. 2004). The RISC functions as RNA scissors to cleave messenger RNA (hereinafter referred to as mRNA) to thereby inhibit the production of protein from mRNA. siRNA contained in the RISC may bind to mRNA having a sequence complementary to the siRNA sequence to form double-stranded RNA, and the RISC may act as RNA scissors to cleave target mRNA so that the mRNA can no longer function as a template that repeatedly produces protein.

The siRNA-based anticancer drugs as described above are considered advanced over the monomolecular anticancer drugs in that they cleave mRNA before protein production and use RNA and the intracellular RISC pathway. However, there is a side effect that cannot be solved even by the siRNA-based technology (Jackson, A. L. et al. Widespread siRNA "off-target" transcript silencing mediated by seed region sequence complementarity. Rna 12, 1179-87, 2006, Jackson, A. L. et al. Position-specific chemical modification of siRNAs reduces "off-target" transcript silencing. Rna 12, 1197-205, 2006, Jackson, A. L. et al. Expression profiling reveals off-target gene regulation by RNAi. Nat Biotechnol 21, 635-7, 2003, Nielsen, C. B. et al. Determinants of targeting by endogenous and exogenous microRNAs and siRNAs. Rna 13, 1894-910, 2007, Peek, A. S. & Behlke, M. A. Design of active small interfering RNAs. Curr Opin Mol Ther 9, 110-8, 2007). This side effect is a phenomenon known as the off-target effect. As described above, siRNA acts to cleave mRNA having a sequence complementary to the siRNA sequence. However, siRNA may also bind to and cleave a non-target mRNA which is not complementary to the entire sequence of the siRNA, but is complementary to only a portion of the siRNA sequence. This phenomenon is known as the off-target effect.

To overcome the above-described technical disadvantage of siRNA-based anticancer agents, studies on the use of microRNA (hereinafter referred to as "miRNA") as therapeutic agents are in progress (Agostini, M. & Knight, R. A. miR-34: from bench to bedside. Oncotarget 5, 872-81, 2014, van Rooij, E., Purcell, A. L. & Levin, A. A. Developing MicroRNA Therapeutics. Circulation Research 110, 496-507, 2012, Burnett, J. C. & Rossi, J. J. RNA-based therapeutics: current progress and future prospects. Chem Biol 19, 60-71, 2012, Dangwal, S. & Thum, T. microRNA therapeutics in cardiovascular disease models. Annu Rev Pharmacol Toxicol 54, 185-203, 2014). miRNA is an RNA consisting of 16 to 27 nucleotides and is classified as protein non-coding RNA against a messenger RNA (mRNA) that is translated into protein (Carthew, R. W. & Sontheimer, E. J. Origins and Mechanisms of miRNAs and siRNAs. Cell 136, 642-55, 2009, MacFarlane, L.-A. & Murphy, P. R. MicroRNA: Biogenesis, Function and Role in Cancer. Current Genomics 11, 537-561, 2010, Bartel, D. P. MicroRNAs: target recognition and regulatory functions. Cell 136, 215-33, 2009). miRNA is found in the genome of higher animal and plant cells, and is known to play a key role in regulating cell metabolisms and functions, including cell production, growth, differentiation and death. Until now, about 2000 kinds of miRNAs have been found in the human genome, and the functions of a considerable amount of the miRNAs are not yet known.

miRNA is transcribed from the genome into RNA by RNA polymerase known as Pol II, and the initial length of the miRNA is various without being specified (Carthew, R. W. & Sontheimer, E. J. Origins and Mechanisms of miRNAs and siRNAs. Cell 136, 642-55, 2009, Brodersen, P. & Voinnet, O. Revisiting the principles of microRNA target recognition and mode of action. Nat Rev Mol Cell Biol 10, 141-148, 2009). This is attributable to the positional variety of miRNA in the genome. This is because miRNA is produced in various ways, including the case in which miRNA located in an intron (mRNA non-coding region) is transcribed at the same time point as mRNA production and in the case in which miRNA located in the intergenic region of the genome is transcribed individually (Malone, C. D. & Hannon, G. J. Small RNAs as guardians of the genome. Cell 136, 656-68, 2009). miRNA produced in the initial stage as described above is known as primary microRNA (miR). Primary miR is processed into precursor miR (precursor miRNA, or pre-miR) by, for example, RNase known as intranuclear Drosha (Bartel, D. P. MicroRNAs: target recognition and regulatory functions. Cell 136, 215-33, 2009). Pre-miR has an RNA hairpin structure and consists of about 70-80 nucleotides. Pre-miR in the cellular nucleus is transported from the nucleus to the cytosol by exportin protein or the like, and is further processed in the cytosol by another RNase known as Dicer to thereby produce double-stranded mature microRNA (hereinafter, miR described without a qualifier means mature miR) consisting of 16-27 nucleotides. One RNA strand of double-stranded miR is selected, activated by binding to the ribonucleoprotein complex RISC, and binds to target mRNA based on the sequence of miR.

Generally, mRNA can be largely divided into three regions based on whether or not these regions are involved in protein coding: a coding region containing protein coding translation information, and 5'-UTR (Un-Translated Region) and 3'-UTR which have no protein coding information. While siRNA that induces cleavage of target mRNA having a sequence complementary thereto acts regardless of the 5'-UTR, 3'-UTR and coding region of mRNA, miR binds mainly to the 3'-UTR (Carthew, R. W. & Sontheimer, E. J. Origins and Mechanisms of miRNAs and siRNAs. Cell 136, 642-55, 2009, Bartel, D. P. MicroRNAs: target recognition and regulatory functions. Cell 136, 215-33, 2009).

In addition to the difference in the position of binding to mRNA, the characteristic difference between siRNA and miRNA is that siRNA binds mainly to mRNA having a sequence complementary to the entire sequence of siRNA, whereas miRNA recognizes target mRNA, mainly through a seed region sequence located 2-8 nucleotides from the 5' end of the miRNA and having a limited length. Thus, even when the entire sequence of miRNA is not completely complementary to the sequence of a target sequence and contains a non-complementary sequence portion, the activity of the miRNA is not affected by the non-complementary sequence portion (Bartel, D. P. MicroRNAs: target recognition and regulatory functions. Cell 136, 215-33, 2009). Since the seed region is 6-8 nucleotides in length, there are various kinds of mRNAs whose 3' UTR has a sequence complementary to the seed region, and for this region, several kinds of mRNAs can be simultaneously controlled using one kind of miRNA. This nature of miRNA enables the miRNA to function as an efficient regulator in the control of many cellular physiological aspects, including cell division, growth, differentiation and death. Furthermore, the function of miRNA as a regulator provides an advantage in achieving effective anticancer effects. This is because miRNA can inhibit expression of a number of oncogenes at the same time, whereas siRNA aims to inhibit expression of a single gene.

The 3' UTR of many mRNAs contains a portion to which one or more miRNAs can bind. According to bioinformatics calculation, it is known that about 30% of all mRNAs is regulated by miRNA.

The fact that miRNA acts as a major regulator in signaling pathways can be seen from the fact that miRNA plays an important role in major diseases, including cancer (MacFarlane, L.-A. & Murphy, P. R. MicroRNA: Biogenesis, Function and Role in Cancer. Current Genomics 11, 537-561. 2010, Malone, C. D. & Hannon, G. J. Small RNAs as guardians of the genome. Cell 136, 656-68. 2009, Nicoloso, M. S., Spizzo, R., Shimizu, M., Rossi, S. & Calin, G. A. MicroRNAs—the micro steering wheel of tumour metastases. Nat Rev Cancer 9, 293-302. 2009, Landi, D., Gemignani, F. & Landi, S. Role of variations within microRNA-binding sites in cancer. Mutagenesis 27, 205-10. 2012). In fact, several studies revealed that expression patterns of miRNAs in cancer cells greatly differ from expression patterns of miRNAs in normal cells. In addition, it is known that expression patterns of miRNAs greatly differ depending on primary organs in which cancer occurred. Specifically, various cancers, including lung cancer, liver cancer, skin cancer and blood cancer, show characteristic miRNA expression patterns according to the primary organs, indicating that miRNA plays an important role in cancer biology. In particular, it is known that the expression levels of miRNAs in cancer cells are generally lower than their expression levels in normal cells.

Based on the deep connection of miRNA in cancer, it has recently been attempted to use miRNAs as anticancer therapeutic agents. For example, miRNA, named "miR-34a", is under clinical trials to verify its abilities to inhibit cancer cell proliferation and induce cancer cell apoptosis (Wiggins, J. F. et al. Development of a lung cancer therapeutic based on the tumor suppressor microRNA-34. Cancer Res 70, 5923-30. 2010, Bader, A. G. et al. miR-34 Regulated Genes and Pathways as Targets for Therapeutic Intervention. Google Patents, 2009, Hermeking, H. The miR-34 family in cancer and apoptosis. Cell Death Differ 17, 193-9. 2010, Chang, T. C. et al. Transactivation of miR-34a by p53 broadly influences gene expression and promotes apoptosis. Mol Cell 26, 745-52. 2007).

Accordingly, the present inventors have made extensive efforts to identify miRNA having better abilities to inhibit cancer cell proliferation and induce cancer cell apoptosis than miR-34a which is under clinical trials. As a result, the present inventors have identified miR-3670, miR-8078 and miR-4477a, which have excellent anticancer efficacy, and have found that these miRNAs exhibit anticancer effects by effectively inhibiting expressions of a number of genes known as oncogenes, thereby competing the present invention.

DISCLOSURE OF INVENTION

Technical Problem

It is an object of the present invention to identify miRNA having excellent abilities to inhibit cancer cell proliferation and induce cancer cell apoptosis, and to provide a pharmaceutical composition for the treatment of cancer, which comprises the miRNA as an active ingredient.

Technical Solution

To achieve the above object, the present invention provides a pharmaceutical composition for treating cancer, which comprises, as an active ingredient, one or more miRNAs selected from the group consisting of miR-3670, miR-8078 and miR-4477a.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

BEST MODE FOR CARRYING OUT THE INVENTION

Figure 1:
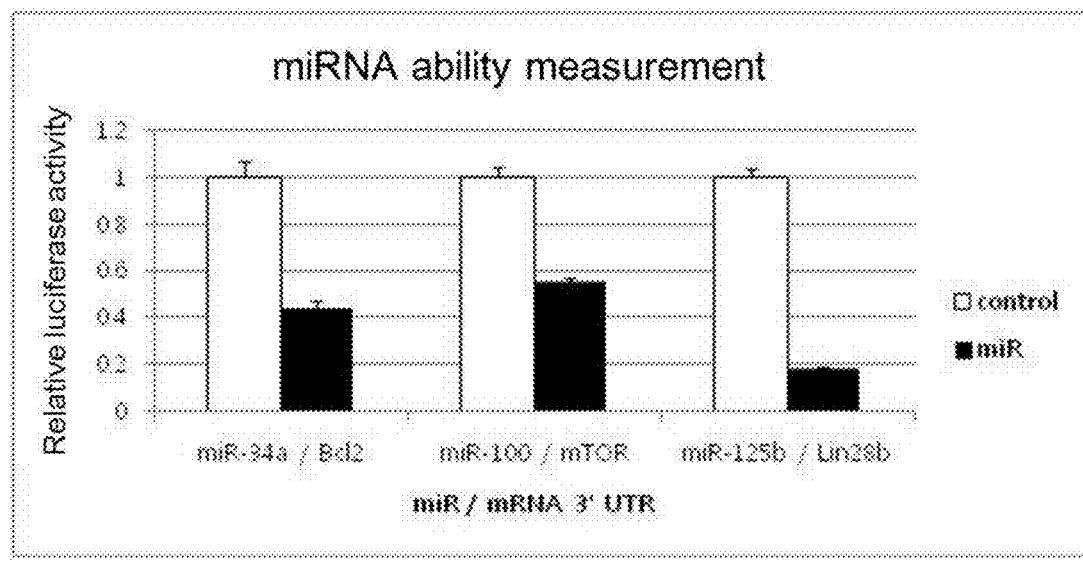
FIG. 1 shows the results of measuring the protein expression inhibitory abilities of miR-34a, miR-100 and miR-125b. In order to measure whether or not the miRNA used in construction of the screening library would have activity, miR-34a, miR-100 and miR-125b were typically selected from an entire screening library, and each of mRNA 3'UTRs known to be silenced by these miRNAs was inserted into the 3'UTR of luciferase expression vectors and the protein expression inhibitory abilities were measured.

Unless defined otherwise, all technical and scientific terms used herein have the same meaning as commonly understood by one of ordinary skill in the art to which the invention pertains. Generally, the nomenclature used herein is those well known and commonly employed in the art.

In the present invention, it has been attempted to identify miRNA having better efficacy than miR-34a known to have anticancer effects and to evaluate the anticancer effects of the identified miRNA.

In the present invention, a screening library consisting of about 1700 miRNAs was synthesized (Table 1). NCI-H460 (lung cancer cell line) was treated with the screening library, and the abilities of the miRNAs to inhibit the growth of the cancer cells were measured. As a result, miR-3670, miR-8078 and miR-4477a, which exhibited better efficacy than miR-34a and have the following nucleotide sequences, were identified (Table 3). It was found that the identified miRNAs have excellent anticancer effects (FIGS. 4 to 8).

Therefore, the present invention is directed to a pharmaceutical composition for treating cancer, which comprises as an active ingredient, one or more miRNAs selected from the group consisting of miR-3670, miR-8078 and miR-4477a.

In the present invention, the miR-3670 may comprise, as an active ingredient, a double-stranded RNA having the nucleotide sequences of SEQ ID NO: 35 and SEQ ID NO: 36 or SEQ ID NO: 35 and SEQ ID NO: 67.

In the present invention, the miR-4477a may comprise, as an active ingredient, a double-stranded RNA having the nucleotide sequences of SEQ ID NO: 43 and SEQ ID NO: 44 or SEQ ID NO: 43 and SEQ ID NO: 68.

In the present invention, the miR-8078 may comprise, as an active ingredient, a double-stranded RNA having the nucleotide sequences of SEQ ID NO: 65 and SEQ ID NO: 66 or SEQ ID NO: 65 and SEQ ID NO: 69.

In other words, an miR-3670 template strand of the present invention may be represented by SEQ ID NO: 35.

(MIMAT0018093. SEQ ID NO: 35)
5'-AGAGCUCACAGCUGUCCUUCUCUA-3'

Although miRNA which is active in vivo is single-stranded, it should be delivered into cells, in a double-stranded form together with a nucleotide sequence having a length similar thereto, so that it will bind to the RISC. Herein, the antisense sequence binding to the sequence is complementary to the active sequence. The complementary sequence may be a perfect complementary sequence or an endogenous sequence. Nucleotides located either at the 3' end of each double-stranded sequence or at the 3' end of one strand may not bind with nucleotides of the antisense sequence, and such nucleotides are known as the 3'-overhang. The double-stranded sequence may comprise the 3'-overhang.

In other words, the perfect complementary sequence of the miR-3670 may be represented by SEQ ID NO: 36.

(SEQ ID NO: 36)
5'-GAGAAGGACAGCUGUGAGCUCUUU-3'

In addition, the endogenous complementary sequence of the miR-3670 may be represented by SEQ ID NO: 67.

(SEQ ID NO: 67)
5'-GACUGGUAUAGCUGCUUUUGGAGCCUCA-3'

As described in the Background Art section above, the seed sequence corresponding to 8-9$^{th}$ nucleotides counting from the second nucleotide of the active sequence of miRNA is the major factor of activity. A long double-stranded sequence comprising the seed region may be used in preparation of double-stranded RNA.

Similarly to miR-3670, active sequences of miR-4477a and miR-8078 and complementary sequences for forming double-stranded sequences therewith may be represented by the following sequences. These double-stranded sequences may comprise the 3'-overhang as described above to form long double-stranded sequences, and may also comprise the seed region to form long double-stranded sequences.

miR-4477a (MIMAT0019004 SEQ ID NO: 43)
5'-CUAUUAAGGACAUUUGUGAUUC-3'

The perfect complementary sequence of the miR-4477a:

(SEQ ID NO: 44)
5'-AUCACAAAUGUCCUUAAUAGUU-3'

The endogenous complementary sequence of the miR-4477a:

(SEQ ID NO: 68)
    5'-AUCACAAAUGUCCUUAAUGGCA-3' miR-8078

(MIMAT0031005, SEQ ID NO: 65)
    5'-GGUCUAGGCCCGGUGAGAGACUC

The perfect complementary sequence of the miR-8078:

(SEQ ID NO: 66)
    5'-GUCUCUCACCGGGCCUAGACCUU

The endogenous complementary sequence of the miR-8078:

(SEQ ID NO: 69)
    5'-CUCCACCGGGCUGACCGGCCUG-3'

In the present invention, it was found that the miRNAs identified through library screening exhibit anticancer effects by controlling genes generally known to play a major role in the induction, production and growth of cancer cells. miRNAs characterized in that one kind of miRNA can simultaneously control expressions of a number of mRNA at the same time. This nature was also found in the present invention, and is useful for the development of new oligo-based anticancer drugs.

Figure 6:
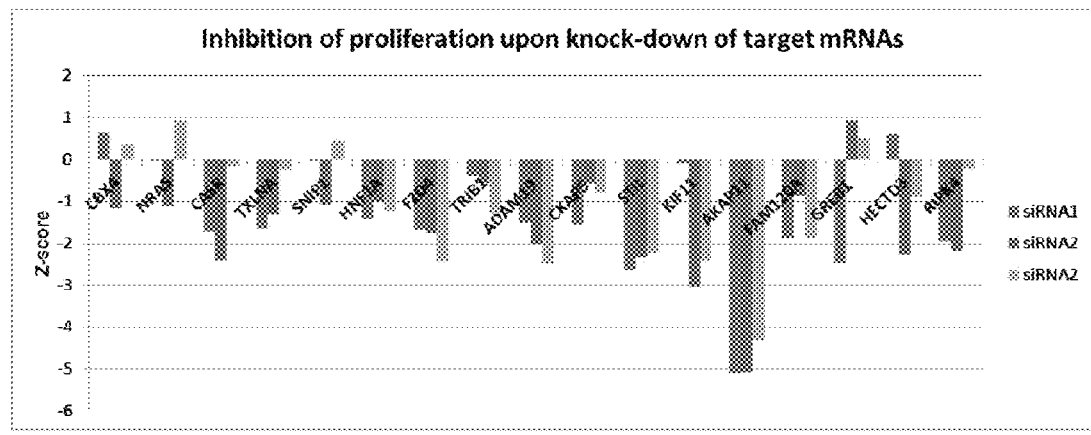
FIG. 6 shows the results obtained by selecting target candidates using the miRNA target prediction software, and expressing the apoptotic abilities of siRNAs, which target the selected candidates, as Z-score.

It was found that the miR-3670 of the present invention inhibits the expressions of the CBX4, NRAS, CASR, TXLNA, SNIP1, HNF1A, FZD4, TRIB1, ADMA19, and CKAP5 at the same time, the miR-8078 inhibits the expressions of GREB1, HECTD3, and RIPK4, and the miR-4477a inhibits the expressions of STIL, KIF11, AKAP11, and FAM120A at the same time (FIG. 6).

Target genes to be inhibited by the miRNA of the present invention are known to have the following functions.

It is known that CBX4 (polycomb chromobox 4) is involved in tumor angiogenesis and stimulation of tumor metastasis, and NRAS plays a major role in tumor growth and cell division (Orouji, E. et al. MAP Kinase pathway gene copy alterations in NRAS/BRAF wild-type advanced melanoma. Int J Cancer (2015); Zheng, C. et al. MicroRNA-195 functions as a tumor suppressor by inhibiting CBX4 in hepatocellular carcinoma. Oncol Rep 33, 1115-22 (2015); Jiao, H. K. et al. Prognostic significance of Cbx4 expression and its beneficial effect for transarterial chemoembolization in hepatocellular carcinoma. Cell Death Dis 6, e1689 (2015); Ohashi, K. et al. Characteristics of lung cancers harboring NRAS mutations. Clin Cancer Res 19, 2584-91 (2013)).

CASR is found to be overexpressed in tumors and is required for tumor metastasis, and TXLNA is known to be related to tumor growth and metastasis. Reported clinical results indicated that a patient group showing high expression levels of TXLNA has low survival rate (Mashidori, T., Shirataki, H., Kamai, T., Nakamura, F. & Yoshida, K. Increased alpha-taxilin protein expression is associated with the metastatic and invasive potential of renal cell cancer. Biomed Res 32, 103-10 (2011); Tennakoon, S., Aggarwal, A. & Kallay, E. The calcium-sensing receptor and the hallmarks of cancer. Biochim Biophys Acta (2015); Ohtomo, N. et al. Expression of alpha-taxilin in hepatocellular carcinoma correlates with growth activity and malignant potential of the tumor. Int J Oncol 37, 1417-23 (2010)).

SNIP1 known as a transcriptional coactivator stimulates expression of cyclin D1 which is essential for cell growth and division. It is known that a patient group showing high expression levels of SNIP1 has poor prognosis. Furthermore, it is known that SNIP1 binds to c-Myc functioning as a major regulator of cell proliferation to thereby stimulate tumor growth (Li, Q. et al. SNIP1: a new activator of HSE signaling pathway. Mol Cell Biochem 362, 1-6 (2012); Fujii, M. et al. SNIP1 is a candidate modifier of the transcriptional activity of c-Myc on E box-dependent target genes. Mol Cell 24, 771-83 (2006); Roche, K. C., Rocha, S., Bracken, C. P. & Perkins, N. D. Regulation of ATR-dependent pathways by the FHA domain containing protein SNIP1. Oncogene 26, 4523-30 (2007); Jeon, H. S. et al. High expression of SNIP1 correlates with poor prognosis in non-small cell lung cancer and SNIP1 interferes with the recruitment of HDAC1 to RB in vitro. Lung Cancer 82, 24-30 (2013); Liang, X. et al. Hypoxia-inducible factor-1 alpha, in association with TWIST2 and SNIP1, is a critical prognostic factor in patients with tongue squamous cell carcinoma. Oral Oncol 47, 92-7 (2011)).

HNF1A and FZD4 are components in the Wnt signaling pathway, which are deeply involved in tumor growth and survival. The Wnt signaling pathways have been intensively studied in tumor biology, and the importance thereof is widely known. TRIB1 is known to play a role to inhibit growth, metastasis and apoptosis of tumor cell and to regulate the MAPK signaling pathway which is a major signaling pathway of tumor growth (Pecina-Slaus, N. et al. Wnt signaling transcription factors TCF-1 and LEF-1 are upregulated in malignant astrocytic brain tumors. Histol Histopathol 29, 1557-64 (2014); Ueno, K. et al. Tumor suppressor microRNA-493 decreases cell motility and migration ability in human bladder cancer cells by downregulating RhoC and FZD4. Mol Cancer Ther 11, 244-53 (2012); Lin, Z. Y. et al. MicroRNA-224 inhibits progression of human prostate cancer by downregulating TRIB1. Int J Cancer 135, 541-50 (2014); Soubeyrand, S., Naing, T., Martinuk, A. & McPherson, R. ERK1/2 regulates hepatocyte Trib1 in response to mitochondrial dysfunction. Biochim Biophys Acta 1833, 3405-14 (2013)).

ADAM19 is a protein distributed in the cell membrane, and is known to perform a variety of biological functions, including cell-cell interactions and cell-extracellular matrix interactions. As known in tumor biology, ADAM19 is deeply associated with tumor growth and metastasis. CKAP5 gene found to play an important role in tumor survival through gene functional screening was found to be controlled by the miRNA in the present invention. GREB1 is associated with the signaling pathways of tissues or tumors that respond to hormones, and is known to be overexpressed in various kinds of tumor cells to stimulate the growth of the cells (Zhang, Q. et al. Role of microRNA-30c targeting ADAM19 in colorectal cancer. PLoS One 10, e0120698 (2015); Shan, N., Shen, L., Wang, J., He, D. & Duan, C. MiR-153 inhibits migration and invasion of human non-small-cell lung cancer by targeting ADAM19. Biochem Biophys Res Commun 456, 385-91 (2015); Martens-de Kemp, S. R. et al. Functional genetic screens identify genes essential for tumor cell survival in head and neck and lung cancer. Clin Cancer Res 19, 1994-2003 (2013); Rae, J. M. et al. GREB1 is a novel androgen-regulated gene required for prostate cancer growth. Prostate 66, 886-94 (2006); Zhang, L. et al. Development of transcriptomic biomarker signature in human saliva to detect lung cancer. Cell Mol Life Sci 69, 3341-50 (2012); Laviolette, L. A., Hodgkinson, K. M., Minhas, N., Perez-Iratxeta, C. & Vanderhyden, B. C. 17betaestradiol upregulates GREB1 and accelerates ovarian tumor progression in vivo. Int J Cancer 135, 1072-84 (2014)).

HECTD3 is E3 ubiquitin ligase and is known to attach polyubiquitin to caspase-8, which triggers apoptosis, to induce degradation of caspase-8, thereby inhibiting tumor cell apoptosis. Also, HECTD3 is known to stabilize MALT1 protein to thereby increase resistance to cisplatin anticancer drugs. RIPK4 is receptor-interacting protein kinase 4, and is known to induce accumulation of the cell growth signaling factor β-catennin and activate the Wnt signaling pathway. It is known that artificial removal of RIPK4 can inhibit tumor growth in tumor animal models (Li, Y. et al. The HECTD3 E3 ubiquitin ligase facilitates cancer cell survival by promoting K63-linked polyubiquitination of caspase-8. Cell Death Dis 4, e935 (2013); Li, Y. et al. The HECTD3 E3 ubiquitin ligase suppresses cisplatin-induced apoptosis via stabilizing MALT1. Neoplasia 15, 39-48 (2013); Huang, X. et al. Phosphorylation of Dishevelled by protein kinase RIPK4 regulates Wnt signaling. Science 339, 1441-5 (2013)).

The STIL gene, which is an essential factor in G2 phase-to-M phase transition in the cell cycle is known to be highly expressed in various kinds of cells and to be necessary for tumor growth and survival. It is known that KIF11 is also necessary for tumor cell growth and metastasis and that inhibition of the activity of KIF11 can inhibit tumor growth (Erez, A. et al. Sil overexpression in lung cancer characterizes tumors with increased mitotic activity. Oncogene 23, 5371-7 (2004); Erez, A. et al. The SIL gene is essential for mitotic entry and survival of cancer cells. Cancer Res 67, 4022-7 (2007); Tang, Y., Orth, J. D., Xie, T. & Mitchison, T. J. Rapid induction of apoptosis during Kinesin-5 inhibitor-induced mitotic arrest in HL60 cells. Cancer Lett 310, 15-24 (2011); Venere, M. et al. The mitotic kinesin KIF11 is a driver of invasion, proliferation, and self-renewal in glioblastoma. Sci Transl Med 7, 304ra143 (2015)).

AKAP11 that binds protein kinase A (PKA) to increase the PKA activity also binds to GSK-3 beta to promote PKA-mediated phosphorylation of GSK-3. Phosphorylated GSK-3 beta loses its activity, which is a major mechanism that is recognized as a growth stimulating signal in cells to induce tumor growth. Tumor cells are exposed to various stress conditions, such as acidic conditions, oxygen deficient conditions, etc., and maintain a mechanism by which death of tumor cells is inhibited even under such severe conditions. For example, it is known that FAM120A that is an RNA-binding protein activates kinases such as Src to inhibit cell apoptosis and increase drug resistance (Logue, J. S. et al. AKAP220 protein organizes signaling elements that impact cell migration. J Biol Chem 286, 39269-81 (2011); Whiting, J. L. et al. Protein Kinase A Opposes the Phosphorylation-dependent Recruitment of Glycogen Synthase Kinase 3beta to A-kinase Anchoring Protein 220. J Biol Chem 290, 19445-57 (2015); Tanji, C. et al. A-kinase anchoring protein AKAP220 binds to glycogen synthase kinase-3beta (GSK-3beta) and mediates protein kinase A-dependent inhibition of GSK-3beta. J Biol Chem 277, 36955-61 (2002); Tanaka, M. et al. A novel RNA-binding protein, Ossa/C9orf10, regulates activity of Src kinases to protect cells from oxidative stress-induced apoptosis. Mol Cell Biol 29, 402-13 (2009); Bartolome, R. A. et al. IL13 Receptor alpha2 Signaling Requires a Scaffold Protein, FAM120A, to Activate the FAK and PI3K Pathways in Colon Cancer Metastasis. Cancer Res 75, 2434-44 (2015)).

Figure 7:
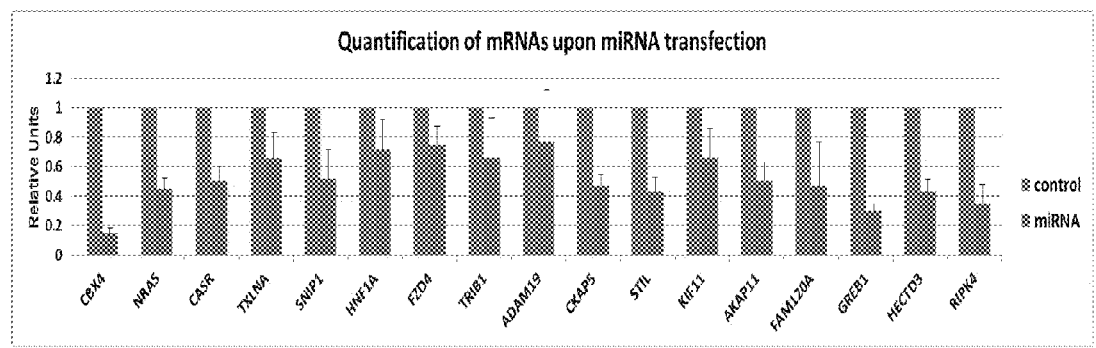
FIG. 7 shows the results of qPCR performed to analyze the extent to which the expression of the genes shown in FIG. 6 would be inhibited by miRNA.
Figure 8:
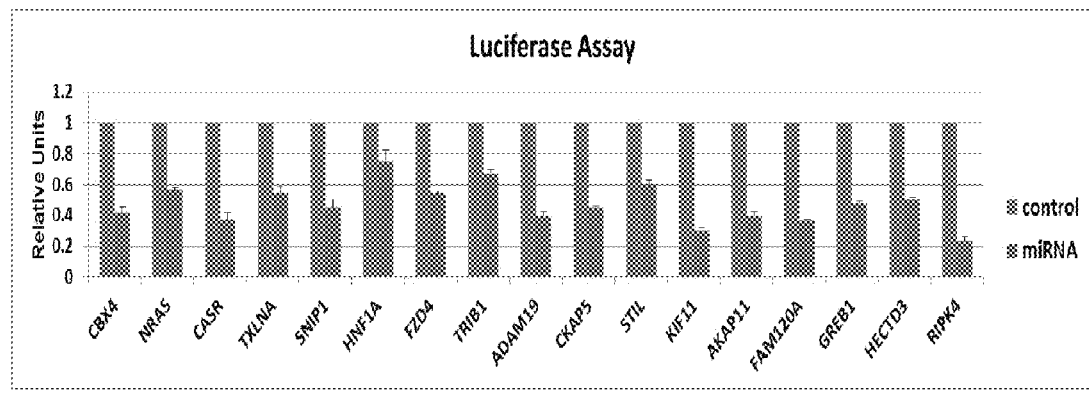
FIG. 8 shows the results obtained by cloning the 3' UTR of the genes, shown in FIG. 6, into the 3' UTR of luciferase, and measuring the extent to which the expression of the luciferase protein would be inhibited by miRNA.

In the present invention, it was shown that, when the intracellular contents of the above-described genes were reduced using siRNA, cell growth was inhibited, like when miR-3670, miR4477a or miR-8078 was used (FIG. 6). In addition, the results of qPCR indicated that when miR-3670, miR-4477a or miR-8078 was delivered into lung cancer cells, the mRNA expression levels of the genes were reduced (FIG. 7). Furthermore, the luciferase assay results indicated that the above-described genes are genes that are targeted directly by miR-3670, miR-4477a or miR-8078 (FIG. 8). This suggests that miR-3670, miR-4477a or miR-8078 directly and simultaneously inhibits expressions of various genes important in tumor cell growth and survival to thereby induce tumor cell apoptosis.

In the present invention, the cancer may be one or more cancers selected from the group consisting of: a primary cancer such as lung cancer, liver cancer, stomach cancer, colorectal cancer, pancreatic cancer, gallbladder and bile duct cancer, breast cancer, leukemia, esophageal cancer, non-Hodgkin lymphoma, thyroid cancer, cervical cancer, or skin cancer; a metastatic carcinoma arising from metastasis to other organs from the primary cancer site of origin; and a neoplastic cell disease caused by the promotion of abnormally excessive cell division, but is not limited thereto.

The sequence of miRNA that can be used as an active ingredient of a pharmaceutical composition for treating cancer according to the present invention is a sequence derived from the human genome, but may be an miRNA sequence obtained from other animal genomes without limiting the miRNA-derived genome to the human genome.

In the present invention, miRNA may be used as various miRNA mimics, which generates biologically equivalent effect. For example, modified miRNA comprising an miRNA sequence containing the same seed region may be used. Herein, the length of SEQ ID NO: 1 or SEQ ID NO: 2 may be reduced, and a short-length miRNA mimic consisting of 15 nucleotides may also be used.

In the present invention, miRNA mimics for the miRNA may partially comprise a phosphorothioate structure in which a RNA phosphate backbone structure is substituted with another element such as sulfur. Moreover, those obtained by wholly or partially substituting RNA with DNA, PNA (peptide nucleic acid) or LNA (locked nucleic acid) molecule may also be used. In addition, those obtained by substituting the 2' hydroxyl group of RNA sugar with various functional structures may also be used. Such modification includes, but not limited to, methylation, methoxylation, fluorination or the like.

In the present invention, miRNA is not limited to the mature miRNA and the double-stranded RNA of the miRNA mimic derived therefrom, but can be used in the form of an miRNA precursor. The miRNA precursor can also be obtained by substitution of the above-described RNA phosphate backbone structure, whole or partial substitution of RNA nucleic acid with a DNA, PNA or LNA molecule, or modification of the 2' hydroxyl group of RNA sugar.

In the present invention, miRNA can be used in the form of an miRNA precursor or a primary miRNA (pri-miRNA), and it can be synthesized by a chemical method or delivered to cells in the form of a plasmid so as to be expressed.

Examples of a method of delivering miRNA to cells cultured in a culture dish, which can be used in the present invention, include a method of using a mixture of miRNA and cationic lipid, a method of delivering miRNA to cells by electrical stimulus, and a method of using virus, but are not limited thereto.

A pharmaceutical composition for treating cancer comprising the miRNA of the present invention as an active ingredient may further comprise a pharmaceutically acceptable carrier, and may be formulated together with the carrier.

As used herein, the term "pharmaceutically acceptable carrier" refers to a carrier or diluent that does not impair the biological activity and characteristics of an administered compound without irritating an organism. As a pharmaceutically acceptable carrier in a composition that is formulated as a liquid solution, a sterile and biocompatible carrier is used. The pharmaceutically acceptable carrier may be physiological saline, sterile water, Ringer's solution, buffered saline, albumin injection solution, dextrose solution, maltodextrin solution, glycerol, ethanol, or a mixture of two or more thereof. In addition, the composition of the present invention may, if necessary, comprise other conventional additives, including antioxidants, buffers, and bacteriostatic agents. Further, the composition of the present invention may be formulated as injectable forms such as aqueous solutions, suspensions or emulsions with the aid of diluents, dispersants, surfactants, binders and lubricants. In addition, the composition according to the present invention may be formulated in the form of pills, capsules, granules, or tablets.

A composition for preventing or treating cancer, which comprises the miRNA of the present invention and a pharmaceutically acceptable carrier, can be applied as any formulation comprising it as an active ingredient and may be prepared as an oral or parenteral formulation. Pharmaceutical formulations of the present invention include those suitable for oral, rectal, nasal, topical (including buccal and sublingual), subcutaneous, vaginal or parenteral (including intramuscular, subcutaneous and intravenous) administration or a form suitable for administration by inhalation or insufflation.

Examples of oral formulations comprising the composition of the present invention as an active ingredient include tablets, troches, lozenges, aqueous or emulsified suspensions, powders, granules, emulsions, hard or soft capsules, syrups, or elixirs. Formulations such as tablets or capsules may include a binder such as lactose, saccharose, sorbitol, mannitol, starch, amylopectin, cellulose or gelatin, an expedient such as dicalcium phosphate, a disintegrant such as corn starch or sweet potato starch, and a lubricant such as magnesium stearate, calcium stearate, sodium stearyl fumarate or polyethylene glycol wax. Capsule formulations may comprise, in addition to the above-mentioned substances, a liquid carrier such as fatty oil.

Parenteral formulations comprising the composition of the present invention as an active ingredient include injectable forms for subcutaneous, intravenous or intramuscular injection, suppositories, or sprays inhalable via the respiratory organ, such as aerosols. Injectable formulations may be prepared by mixing the composition of the present invention with a stabilizer or a buffer in water to prepare a solution or a suspension, and loading the solution or suspension into ampules or vials to prepare unit dosage forms. Suppository formulations include suppositories or retention enemas, e.g. containing conventional suppository bases such as cocoa buffer or other glycerides. For spray formulations, such as aerosols, a propellant for spraying a water-dispersed concentrate or wet powder may be used in combination with an additive.

EXAMPLES

Hereinafter, the present invention will be described in further detail with reference to examples. It will be obvious to a person having ordinary skill in the art that these examples are for illustrative purposes only and are not to be construed to limit the scope of the present invention.

Example 1: Construction of miRNA Screening Library

Based on stem-loop structure the 21 version human miRNA sequence provided from the miRNA database miRBase (www.mirbase.org), a screening library consisting of about 1700 kinds of miRNAs was synthesized as double-stranded miRNA sequences by a solid synthesis method that is used in conventional oligo synthesis. Each strand of the synthesized miRNAs was purified by reverse phase separation using C18 resin. All the synthesized miRNA strands were analyzed by MALDI-TOF MS spectrometry to determine whether or not the desired sequences were synthesized. For synthesis of double-stranded miRNAs, complementary strands were heated in the presence of salt at 95° C. for 2 minutes, and then cooled slowly for preparation of double strands.

TABLE 1 miRNA Sequences

| miRNA | SEQ ID NO | Sequence 1 | SEQ ID NO | Sequence 2 |
|---|---|---|---|---|
| hsa-let-7a-1 | 70 | UGAGGUAGUAGGUUGUAUAGUU | 71 | CUAUACAAUCUACUGUCUUUC |
| hsa-let-7a-2 | 72 | UGAGGUAGUAGGUUGUAUAGUU | 73 | CUGUACAGCCUCCUAGCUUUCC |
| hsa-let-7b | 74 | CUAUACAACCUACUGCCUUCCC | 75 | UGAGGUAGUAGGUUGUGUGGUU |
| hsa-let-7c | 76 | UGAGGUAGUAGGUUGUAUGGUU | 77 | CUGUACAACCUUCUAGCUUUCC |
| hsa-let-7d | 78 | CUAUACGACCUGCUGCCUUUCU | 79 | AGAGGUAGUAGGUUGCAUAGUU |
| hsa-let-7e | 80 | CUAUACGGCCUCCUAGCUUUCC | 81 | UGAGGUAGGAGGUUGUAUAGUU |
| hsa-let-7f-1 | 82 | UGAGGUAGUAGAUUGUAUAGUU | 83 | CUAUACAAUCUAUUGCCUUCCC |
| hsa-let-7f-2 | 84 | UGAGGUAGUAGAUUGUAUAGUU | 85 | CUAUACAGUCUACUGUCUUUCC |
| hsa-let-7g | 86 | CUGUACAGGCCACUGCCUUGC | 87 | UGAGGUAGUAGUUUGUACAGUU |
| hsa-let-7i | 88 | UGAGGUAGUAGUUUGUGCUGUU | 89 | CUGCGCAAGCUACUGCCUUGCU |
| hsa-miR-1 | 90 | UGGAAUGUAAAGAAGUAUGUAU | 91 | ACAUACUUCUUUAUAUGCCCAU |
| hsa-miR-100 | 92 | CAAGCUUGUAUCUAUAGGUAUG | 93 | AACCCGUAGAUCCGAACUUGUG |
| hsa-miR-101 | 94 | UACAGUACUGUGAUAACUGAA | 95 | CAGUUAUCACAGUGCUGAUGCU |
| hsa-miR-103a | 96 | AGCAGCAUUGUACAGGGCUAUGA | 97 | AGCUUCUUUACAGUGCUGCCUUG |
| hsa-miR-103b | 98 | UCAUAGCCCUGUACAAUGCUGCU | 99 | CAGCAUUGUACAGGGCUAUGAUU |
| hsa-miR-105 | 100 | UCAAAUGCUCAGACUCCUGUGGU | 101 | ACGGAUGUUUGAGCAUGUGCUA |
| hsa-miR-106a | 102 | CUGCAAUGUAAGCACUUCUUAC | 103 | AAAAGUGCUUACAGUGCAGGUAG |
| hsa-miR-106b | 104 | UAAAGUGCUGACAGUGCAGAU | 105 | CCGCACUGUGGGUACUUGCUGC |
| hsa-miR-107 | 106 | AGCAGCAUUGUACAGGGCUAUCA | 107 | AUAGCCCUGUACAAUGCUGCUUU |
| hsa-miR-10a | 108 | CAAAUUCGUAUCUAGGGGAAUA | 109 | UACCCUGUAGAUCCGAAUUUGUG |
| hsa-miR-10b | 110 | ACAGAUUCGAUUCUAGGGGAAU | 111 | UACCCUGUAGAACCGAAUUUGUG |
| hsa-miR-1178 | 112 | UUGCUCACUGUUCUUCCCUAG | 113 | CAGGGUCAGCUGAGCAUG |

TABLE 1-continued miRNA Sequences

| miRNA | SEQ ID NO | Sequence 1 | SEQ ID NO | Sequence 2 |
|---|---|---|---|---|
| hsa-miR-1179 | 114 | AAGCAUUCUUUCAUUGGUUGG | 115 | AACCAAUGAAAGAAUGCUUUU |
| hsa-miR-1180 | 116 | UUUCCGGCUCGCGUGGGUGUGU | 117 | GGACCCACCCGGCCGGGAAUA |
| hsa-miR-1181 | 118 | CCGUCGCCGCCACCCGAGCCG | 119 | GCUCGGGUGGCGGCGACGGUU |
| hsa-miR-1182 | 120 | GAGGGUCUUGGGGAGGGAUGUGAC | 121 | CACAUCCCUCCCAAGACCCUCUU |
| hsa-miR-1183 | 122 | CACUGUAGGUGAUGGUGAGAGUGGGCA | 123 | CCCACUCUCACCAUCACCUACAGUGUU |
| hsa-miR-1184 | 124 | CCUGCAGCGACUUGAUGGCUUCC | 125 | AAGCCAUCAAGUCGCUGCAGGUU |
| hsa-miR-1185-1 | 126 | AGAGGAUACCCUUUGUAUGUU | 127 | AUAUACAGGGGGAGACUCUUAU |
| hsa-miR-1185-2 | 128 | AGAGGAUACCCUUUGUAUGUU | 129 | AUAUACAGGGGGAGACUCUCAU |
| hsa-miR-1193 | 130 | GGGAUGGUAGACCGGUGACGUGC | 131 | ACGUCACCGGUCUACCAUCCCUU |
| hsa-miR-1197 | 132 | UAGGACACAUGGUCUACUUCU | 133 | AAGUAGACCAUGUGUCCUAUU |
| hsa-miR-1199 | 134 | CCUGAGCCCGGGCCGCGCAG | 135 | UGCGGCCGGUGCUCAACCUGC |
| hsa-miR-1200 | 136 | CUCCUGAGCCAUUCUGAGCCUC | 137 | GGCUCAGAAUGGCUCAGGAGUU |
| hsa-miR-1202 | 138 | GUGCCAGCUGCAGUGGGGGAG | 139 | CCCCCACUGCAGCUGGCACUU |
| hsa-miR-1203 | 140 | CCCGGAGCCAGGAUGCAGCUC | 141 | GCUGCAUCCUGGCUCCGGGUU |
| hsa-miR-1204 | 142 | UCGUGGCCUGGUCUCCAUUAU | 143 | AAUGGAGACCAGGCCACGAUU |
| hsa-miR-1205 | 144 | UCUGCAGGGUUUGCUUUGAG | 145 | CAAAGCAAACCCUGCAGAUU |
| hsa-miR-1206 | 146 | UGUUCAUGUAGAUGUUUAAGC | 147 | UUAAACAUCUACAUGAACAUU |
| hsa-miR-1207 | 148 | UGGCAGGGAGGCUGGGAGGGG | 149 | UCAGCUGGCCCUCAUUUC |
| hsa-miR-1208 | 150 | UCACUGUUCAGACAGGCGGA | 151 | CGCCUGUCUGAACAGUGAUU |
| hsa-miR-122 | 152 | UGGAGUGUGACAAUGGUGUUUG | 153 | AACGCCAUUAUCACACUAAAUA |
| hsa-miR-1224 | 154 | CCCCACCUCCUCUCUCCUCAG | 155 | GUGAGGACUCGGGAGGUGG |
| hsa-miR-1225 | 156 | GUGGGUACGGCCCAGUGGGGGG | 157 | UGAGCCCCUGUGCCGCCCCCAG |
| hsa-miR-1226 | 158 | GUGAGGGCAUGCAGGCCUGGAUGGGG | 159 | UCACCAGCCCUGUGUUCCCUAG |
| hsa-miR-1227 | 160 | GUGGGGCCAGGCGGUGG | 161 | CGUGCCACCCUUUUCCCAG |
| hsa-miR-1228 | 162 | GUGGGCGGGGGCAGGUGUGUG | 163 | UCACACCUGCCUCGCCCCCC |
| hsa-miR-1229 | 164 | GUGGGUAGGGUUUGGGGGAGAGCG | 165 | CUCUCACCACUGCCCUCCCACAG |
| hsa-miR-1231 | 166 | GUGUCUGGGCGGACAGCUGC | 167 | AGCUGUCCGCCCAGACACUU |
| hsa-miR-1233 | 168 | AGUGGGAGGCCAGGGCACGGCA | 169 | UGAGCCCUGUCCUCCCGCAG |
| hsa-miR-1234 | 170 | UCGGCCUGACCACCCACCCCAC | 171 | GGGGUGGGUGGUCAGGCCGAUU |
| hsa-miR-1236 | 172 | UGAGUGACAGGGGAAAUGGGGA | 173 | CCUCUUCCCCUUGUCUCUCCAG |
| hsa-miR-1237 | 174 | CGGGGCGGGGCCGAAGCGCG | 175 | UCCUUCUGCUCCGUCCCCAG |
| hsa-miR-1238 | 176 | CUUCCUCGUCUGUCUGCCCC | 177 | GUGAGUGGGAGCCCCAGUGUGUG |
| hsa-miR-124 | 178 | UAAGGCACGCGGUGAAUGCC | 179 | CGUGUUCACAGCGGACCUUGAU |
| hsa-miR-1243 | 180 | AACUGGAUCAAUUAUAGGAGUG | 181 | CUCCUAUAAUUGAUCCAGUUUU |
| hsa-miR-1244 | 182 | AAGUAGUUGGUUUGUAUGAGAUGGUU | 183 | CCAUCUCAUACAAACCAACUACUUUU |
| hsa-miR-1245a | 184 | AAGUGAUCUAAAGGCCUACAU | 185 | GUAGGCCUUUAGAUCACUUUU |
| hsa-miR-1245b | 186 | UCAGAUGAUCUAAAGGCCUAUA | 187 | UAGGCCUUUAGAUCACUAAA |
| hsa-miR-1246 | 188 | AAUGGAUUUUUGGAGCAGG | 189 | UGCUCCAAAAAUCCAUUUU |
| hsa-miR-1247 | 190 | CCCCGGGAACGUCGAGACUGGAGC | 191 | ACCCGUCCCGUUCGUCCCCGGA |
| hsa-miR-1248 | 192 | ACCUUCUUGUAUAAGCACUGUGCUAAA | 193 | UAGCACAGUGCUUAUACAAGAAGGUUU |
| hsa-miR-1249 | 194 | ACGCCCUUCCCCCCCCUUCUUCA | 195 | AGGAGGGAGGAGAUGGGCCAAGUU |
| hsa-miR-1250 | 196 | ACAUUUCCAGCCCAUUCA | 197 | ACGGUGCUGGAUGUGGCCUUU |
| hsa-miR-1251 | 198 | CGCUUUGCUCAGCCAGUGUAG | 199 | ACUCUAGCUGCCAAAGGCGCU |
| hsa-miR-1252 | 200 | AGAAGGAAAUUGAAUUCAUUUA | 201 | CAAAUGAGCUUAAUUUCCUUUU |
| hsa-miR-1253 | 202 | AGAGAAGAAGAUCAGCCUGCA | 203 | CAGGCGAUCUUCUUCUCUGUU |
| hsa-miR-1254 | 204 | AGCCUGGAAGCUGGAGCCUGCAGU | 205 | UGCAGGCUCCAGCUUCCAGGCUUU |
| hsa-miR-1255a | 206 | AGGAUGAGCAAAGAAAGUAGAUU | 207 | UCUACUUUCUUUGCUCAUCCUUU |
| hsa-miR-1255b | 208 | AACCACUUUCUUUGCUCAUCCA | 209 | CGGAUGAGCAAAGAAAGUGGUU |
| hsa-miR-1256 | 210 | AGGCAUUGACUUCUCACUAGCU | 211 | CUAGUGAGAAGUCAAUGCCUUU |
| hsa-miR-1257 | 212 | AGUGAAUGAUGGGUUCUGACC | 213 | UCAGAACCCAUCAUUCACUUU |
| hsa-miR-1258 | 214 | AGUUAGGAUUAGGUCGUGGAA | 215 | CCACGACCUAAUCCUAACUUU |
| hsa-miR-125a | 216 | ACAGGUGAGGUUCUUGGGAGCC | 217 | UCCCUGAGACCCUUUAACCUGUGA |
| hsa-miR-125b-1 | 218 | UCCCUGAGACCCUAACUUGUGA | 219 | ACGGGUUAGGCUCUUGGGAGCU |
| hsa-miR-125b-2 | 220 | UCCCUGAGACCCUAACUUGUGA | 221 | UCACAAGUCAGGCUCUUGGGAC |
| hsa-miR-126 | 222 | UCGUACCGUGAGUAAUAAUGCG | 223 | CAUUAUUACUUUUGGUACGCG |
| hsa-miR-1260a | 224 | AUCCCACCUCUGCCACCA | 225 | GUGGCAGAGGUGGGAUUU |
| hsa-miR-1260b | 226 | AUCCCACCACUGCCACCAU | 227 | GGUGGCAGUGGUGGGAUUU |
| hsa-miR-1261 | 228 | AUGGAUAAGGCUUUGGCUU | 229 | GCCAAAGCCUUAUCCAUUU |
| hsa-miR-1262 | 230 | AUGGGUGAAUUUGUAGAAGGAU | 231 | CCUUCUACAAAUUCACCCAUUU |
| hsa-miR-1263 | 232 | AUGGUACCCUGGCAUACUGAGU | 233 | UCAGUAUGCCAGGGUACCAUUU |
| hsa-miR-1264 | 234 | CAAGUCUUAUUUGAGCACCUGUU | 235 | CAGGUGCUCAAAUAAGACUUGUU |
| hsa-miR-1265 | 236 | CAGGAUGUGGUCAAGUGUUGUU | 237 | CAACAAUUGACCACAUCCUGUU |
| hsa-miR-1266 | 238 | CCUCAGGGCUGUAGAACAGGGCU | 239 | CCCUGUUCUAUGCCCUGAGGGA |
| hsa-miR-1267 | 240 | CCUGUUGAAGUGUAAUCCCCA | 241 | GGGAUUACACUUCAACAGGUU |
| hsa-miR-1268a | 242 | CGGGCGUGGUGGUGGGGG | 243 | CCCACCACCACGCCCGUU |
| hsa-miR-1268b | 244 | CGGGCGUGGUGGUGGGGGUG | 245 | CCCCCACCACCACGCCCGUU |
| hsa-miR-1269a | 246 | CUGGACUGAGCCGUGCUACUGG | 247 | AGUAGCACGCUCAGUCCAGUU |
| hsa-miR-1269b | 248 | CUGGACUGAGCCAUGCUACUGG | 249 | AGUAGCAUGGCUCAGUCCAGUU |
| hsa-miR-127 | 250 | UCGGAUCCGUCUGAGCUUGGCU | 251 | CUGAAGCUCAGAGGGCUCUGAU |
| hsa-miR-1270 | 252 | CUGGAGAUAUGGAAGAGCUGUGU | 253 | ACAGCUCUUCCAUAUCUCCAGUU |
| hsa-miR-1271 | 254 | AGUGCCUGCUAUGUGCCAGGCA | 255 | CUUGGCACCUAGCAAGCACUCA |
| hsa-miR-1272 | 256 | GAUGAUGAUGGCAGCAAAUUCUGAAA | 257 | UCAGAAUUUGCUGCCAUCAUCUCUU |
| hsa-miR-1273a | 258 | GGGCGACAAAGCAAGACUCUUUCUU | 259 | GAAAGAGUCUUGCUUUGUCGCCUU |
| hsa-miR-1273c | 260 | GGCGACAAAACGAGACCCUGUC | 261 | CAGGGUCUCGUUUUGUCGCCUU |
| hsa-miR-1273d | 262 | GAACCCAUGAGGUUGAGGCUGCAGU | 263 | UGCAGCCUCAACCUCAUGGGUUCUU |

TABLE 1-continued miRNA Sequences

| miRNA | SEQ ID NO | Sequence 1 | SEQ ID NO | Sequence 2 |
|---|---|---|---|---|
| hsa-miR-1273e | 264 | UUGCUUGAACCCAGGAAGUGGA | 265 | CACUUCCUGGGUUCAAGCAAUU |
| hsa-miR-1273f | 266 | GGAGAUGGAGGUUGCAGUG | 267 | CUGCAACCUCCAUCUCCUU |
| hsa-miR-1273g | 268 | GGUGGUUGAGGCUGCAGUAAGU | 269 | ACCACUGCACUCCAGCCUGAG |
| hsa-miR-1273h | 270 | CUGGGAGGUCAAGGCUGCAGU | 271 | CUGCAGACUCGACCUCCCAGGC |
| hsa-miR-1275 | 272 | GUGGGGGAGAGGCUGUC | 273 | CAGCCUCUCCCCCACUU |
| hsa-miR-1276 | 274 | UAAAGAGCCCUGUGGAGACA | 275 | UCUCCACAGGGCUCUUUAUU |
| hsa-miR-1277 | 276 | UACGUAGAUAUAUAUGUAUUU | 277 | AAAUAUAUAUAUAUGUACGUAU |
| hsa-miR-1278 | 278 | UAGUACUGUGCAUAUCAUCUAU | 279 | AGAUGAUAUGCACAGUACUAUU |
| hsa-miR-1279 | 280 | UCAUAUUGCUUCUUUCU | 281 | AAAGAAGCAAUAUGAUU |
| hsa-miR-128-1 | 282 | UCACAGUGAACCGGUCUCUUU | 283 | CGGGGCCGUAGCACUGUCUGAGA |
| hsa-miR-128-2 | 284 | UCACAGUGAACCGGUCUCUUU | 285 | GGGGGCCGAUACACUGUACGAGA |
| hsa-miR-1281 | 286 | UCGCCUCCUCCUCUCCC | 287 | GAGAGGAGGAGGCGAUU |
| hsa-miR-1282 | 288 | UCGUUUGCCUUUUUCUGCUU | 289 | GCAGAAAAGGCAAACGAUU |
| hsa-miR-1283 | 290 | UCUACAAAGGAAAGCGCUUUCU | 291 | AAAGCGCUUUCCUUUGUAGAUU |
| hsa-miR-1284 | 292 | UCUAUACAGACCCUGGCUUUUC | 293 | AAAGCCAGGGUCUGUAUAGAUU |
| hsa-miR-1285 | 294 | UCUGGGCAACAAAGUGAGACCU | 295 | GAUCUCACUUUGUUGCCCAGG |
| hsa-miR-1286 | 296 | UGCAGGACCAAGAUGAGCCCU | 297 | GGCUCAUCUUGGUCCUGCAUU |
| hsa-miR-1287 | 298 | CUCUAGCCACAGAUGCAGUGAU | 299 | UGCUGGAUCAGUGGUUCGAGUC |
| hsa-miR-1288 | 300 | UGGACUGCCCUGAUCUGGAGA | 301 | GCAGAUCAGGACUGUAACUCACC |
| hsa-miR-1289 | 302 | UGGAGUCCAGGAAUCUGCAUUUU | 303 | AAUGCAGAUUCCUGGACUCCAUU |
| hsa-miR-129-1 | 304 | CUUUUUGCGGUCUGGGCUUGC | 305 | AAGCCCUUACCCCAAAAAGUAU |
| hsa-miR-129-2 | 306 | CUUUUUGCGGUCUGGGCUUGC | 307 | AAGCCCUUACCCCAAAAAGCAU |
| hsa-miR-1290 | 308 | UGGAUUUUUGGAUCAGGGA | 309 | CCUGAUCCAAAAAUCCAUU |
| hsa-miR-1291 | 310 | UGGCCCUGACUGAAGACCAGCAGU | 311 | UGCUGGCUUCUUCAGUCAGGGCCAUU |
| hsa-miR-1292 | 312 | UGGGAACGGGUUCCGGCAGACGCUG | 313 | UCGCGCCCCGGCUCCCGUUC |
| hsa-miR-1293 | 314 | UGGGUGGUCUGGAGAUUUGUGC | 315 | ACAAAUCUCCAGACCACCCAUU |
| hsa-miR-1294 | 316 | UGUGAGGUUGGCAUUGUUGUCU | 317 | ACAACAAUGCCAACCUCACAUU |
| hsa-miR-1295a | 318 | UUAGGCCGCAGAUCUGGGUGA | 319 | ACCCAGAUCUGCGGCCUAAUU |
| hsa-miR-1295b | 320 | AAUAGGCCACGGAUCUGGGCAA | 321 | CACCCAGAUCUGCGGCCUAAU |
| hsa-miR-1296 | 322 | UUAGGGCCCUGGCUCCAUCUCC | 323 | GAGUGGGGCUUCGACCCUAACC |
| hsa-miR-1297 | 324 | UUCAAGUAAUUCAGGUG | 325 | CCUGAAUUACUUGAAUU |
| hsa-miR-1298 | 326 | CAUCUGGGCAACUGACUGAAC | 327 | UUCACUCGGCUGUCCAGAUGUA |
| hsa-miR-1299 | 328 | UUCUGGAAUUCUGUGUGAGGGA | 329 | CCUCACACAGAAUUCCAGAAUU |
| hsa-miR-1301 | 330 | CGCUCUAGGCACCGCAGCA | 331 | UUGCAGCUGCCUGGGAGUGACUUC |
| hsa-miR-1302 | 332 | UUGGGACAUACUUUAUGCUAAA | 333 | UAGCAUAAGUAUGUCCCAAUU |
| hsa-miR-1303 | 334 | UUUAGAGACGGGGUCUUGCUCU | 335 | AGCAAGACCCCGUCUCUAAAUU |
| hsa-miR-1304 | 336 | UUUGAGGCUACAGUGAGAUGUG | 337 | UCUCACUGUAGCCUCGAACCCC |
| hsa-miR-1305 | 338 | UUUUCAACUCUAAUGGGAGAGA | 339 | UCUCCCAUUAGAGUUGAAAAUU |
| hsa-miR-1306 | 340 | CCACCUCCCCUGCAAACGUCCA | 341 | ACGUUGGCUCUGGUGGUG |
| hsa-miR-1307 | 342 | ACUCGGCGUGGCGUCGGUCGUG | 343 | UCGACCGGACCUCGACCGGCU |
| hsa-miR-130a | 344 | UUCACAUUGUGCUACUGUCUGC | 345 | CAGUGCAAUGUUAAAAGGGCAU |
| hsa-miR-130b | 346 | CAGUGCAAUGAUGAAAGGGCAU | 347 | ACUCUUUCCCUGUUGCACUAC |
| hsa-miR-132 | 348 | UAACAGUCUACAGCCAUGGUCG | 349 | ACCGUGGCUUUCGAUUGUUACU |
| hsa-miR-1321 | 350 | CAGGGAGGUGAAUGUGAU | 351 | CACAUUCACCUCCCUGUU |
| hsa-miR-1322 | 352 | GAUGAUGCUGCUGAUGCUG | 353 | GCAUCAGCAGCAUCAUCUU |
| hsa-miR-1323 | 354 | UCAAAACUGAGGGGCAUUUUCU | 355 | AAAAUGCCCCUCAGUUUUGAUU |
| hsa-miR-1324 | 356 | CCAGACAGAAUUCUAUGCACUUUC | 357 | AAGUGCAUAGAAUUCUGUCUGGUU |
| hsa-miR-133a | 358 | AGCUGGUAAAAUGGAACCAAAU | 359 | UUUGGUCCCCUUCAACCAGCUG |
| hsa-miR-133b | 360 | UUUGGUCCCCUUCAACCAGCUA | 361 | GCUGGUAGGGAGGACCAAAUU |
| hsa-miR-134 | 362 | UGUGACUGGUUGACCAGAGGGG | 363 | CCUGUGGGCCACCUAGUCACCAA |
| hsa-miR-1343 | 364 | CUCCUGGGGCCCGCACUCUCGC | 365 | UGGGGAGCGGCCCCCGGGUGGG |
| hsa-miR-135a | 366 | UAUAGGGAUUGGAGCCGUGGCG | 367 | UAUGGCUUUUUAUUCCUAUGUGA |
| hsa-miR-135b | 368 | AUGUAGGGCUAAAAGCCAUGGG | 369 | UAUGGCUUUUCAUUCCUAUGUGA |
| hsa-miR-136 | 370 | CAUCAUCGUCUCAAAUGAGUCU | 371 | ACUCCAUUUGUUUUGAUGAUGGA |
| hsa-miR-137 | 372 | UUAUUGCUUAAGAAUACGCGUAG | 373 | ACGCGUAUUCUUAAGCAAUAAUU |
| hsa-miR-138-1 | 374 | AGCUGGUGUUGUGAAUCAGGCCG | 375 | GCUACUUCACAACACCAGGGCC |
| hsa-miR-138-2 | 376 | AGCUGGUGUUGUGAAUCAGGCCG | 377 | GCUAUUUCACGACACCAGGGUU |
| hsa-miR-139 | 378 | UCUACAGUGCACGUGUCUCCAGU | 379 | UGGAGACGCGGCCCUGUUGGAGU |
| hsa-miR-140 | 380 | CAGUGGUUUUACCCUAUGGUAG | 381 | UACCACAGGGUAGAACCACGG |
| hsa-miR-141 | 382 | UAACACUGUCUGGUAAAGAUGG | 383 | CAUCUUCCAGUACAGUGUUGGA |
| hsa-miR-142 | 384 | CAUAAAGUAGAAAGCACUACU | 385 | UGUAGUGUUUCCUACUUUAUGGA |
| hsa-miR-143 | 386 | GGUGCAGUGCUGCAUCUCUGGU | 387 | UGAGAUGAAGCACUGUAGCUC |
| hsa-miR-144 | 388 | UACAGUAUAGAUGAUGUACU | 389 | GGAUAUCAUCAUAUACUGUAAG |
| hsa-miR-145 | 390 | GUCCAGUUUUCCCAGGAAUCCCU | 391 | GGAUUCCUGGAAAUACUGUUCU |
| hsa-miR-1468 | 392 | CUCCGUUUGCCUGUUUCGCUG | 393 | AGCAAAAUAAGCAAAUGGAAAA |
| hsa-miR-1469 | 394 | CUCGGCGCGGGGCGCGGGCUCC | 395 | AGCCCGCCCCGCCGCCGAGUU |
| hsa-miR-146a | 396 | UGAGAACUGAAUUCCAUGGGUU | 397 | CCUCUGAAAUUCAGUUCUUCAG |
| hsa-miR-146b | 398 | UGCCCUGUGGACUCAGUUCUGG | 399 | UGAGAACUGAAUUCCAUAGGCU |
| hsa-miR-1470 | 400 | GCCCUCCGCCCGUGCACCCCG | 401 | GGGUGCACGGGCGGAGGGCUU |
| hsa-miR-1471 | 402 | GCCCGCGUGUGGAGCCAGGUGU | 403 | ACCUGGCUCCACACGCGGGCAU |
| hsa-miR-147a | 404 | GUGUGUGGAAAUGCUUCUGC | 405 | AGAAGCAUUUCCACACACUU |
| hsa-miR-147b | 406 | GUGUGCGGAAAUGCUUCUGCUA | 407 | GCAGAAGCAUUUCCGCACACUU |
| hsa-miR-148a | 408 | AAAGUUCUGAGACACUCCGACU | 409 | UCAGUGCACUACAGAACUUUGU |
| hsa-miR-148b | 410 | AAGUUCUGUUAUACACUCAGGC | 411 | UCAGUGCAUCACAGAACUUUGU |
| hsa-miR-149 | 412 | AGGGAGGGACGGGGGCUGUGC | 413 | UCUGGCUCCGUGUCUUCACUCCC |

TABLE 1-continued miRNA Sequences

| miRNA | SEQ ID NO | Sequence 1 | SEQ ID NO | Sequence 2 |
|---|---|---|---|---|
| hsa-miR-150 | 414 | CUGGUACAGGCCUGGGGGACAG | 415 | UCUCCCAACCCUUGUACCAGUG |
| hsa-miR-151a | 416 | UCGAGGAGCUCACAGUCUAGU | 417 | CUAGACUGAAGCUCCUUGAGG |
| hsa-miR-151b | 418 | UCGAGGAGCUCACAGUCU | 419 | ACUGUGAGCUCCUCGAUU |
| hsa-miR-152 | 420 | AGGUUCUGUGAUACACUCCGACU | 421 | UCAGUGCAUGACAGAACUUGG |
| hsa-miR-153 | 422 | UCAUUUUUGUGAUGUUGCAGCU | 423 | UUGCAUAGUCACAAAAGUGAUC |
| hsa-miR-1537 | 424 | AGCUGUAAUUAGUCAGUUUUCU | 425 | AAAACCGUCUAGUUACAGUUGU |
| hsa-miR-1538 | 426 | CGGCCCCGGGCUGCUGCUGUUCCU | 427 | GAACAGCAGCAGCCCGGGCCGUU |
| hsa-miR-1539 | 428 | UCCUGCGCGUCCCAGAUGCCC | 429 | GCAUCUGGGACGCGCAGGAUU |
| hsa-miR-154 | 430 | AAUCAUACACGGUUGACCUAUU | 431 | UAGGUUAUCCGUGUUGCCUUCG |
| hsa-miR-155 | 432 | CUCCUACAUAUUAGCAUUAACA | 433 | UUAAUGCUAAUCGUGAUAGGGGU |
| hsa-miR-1587 | 434 | UUGGGCUGGGCUGGGUUGGG | 435 | CAACCCAGCCCAGCCCAAUU |
| hsa-miR-15a | 436 | CAGGCCAUAUUGUGCUGCCUCA | 437 | UAGCAGCACAUAAUGGUUUGUG |
| hsa-miR-15b | 438 | CGAAUCAUUAUUUGCUGCUCUA | 439 | UAGCAGCACAUCAUGGUUUACA |
| hsa-miR-16-1 | 440 | UAGCAGCACGUAAAUAUUGGCG | 441 | CCAGUAUUAACUGUGCUGCUGA |
| hsa-miR-16-2 | 442 | UAGCAGCACGUAAAUAUUGGCG | 443 | CCAAUAUUACUGUGCUGCUUUA |
| hsa-miR-17 | 444 | ACUGCAGUGAAGGCACUUGUAG | 445 | CAAAGUGCUUACAGUGCAGGUAG |
| hsa-miR-181a-1 | 446 | AACAUUCAACGCUGUCGGUGAGU | 447 | ACCAUCGACCGUUGAUUGUACC |
| hsa-miR-181a-2 | 448 | AACAUUCAACGCUGUCGGUGAGU | 449 | ACCAUCGACCGUUGACUGUACC |
| hsa-miR-181b-1 | 450 | AACAUUCAUUGCUGUCGGUGGGU | 451 | CUCACUGAACAAUGAAUGCAA |
| hsa-miR-181b-2 | 452 | AACAUUCAUUGCUGUCGGUGGGU | 453 | CUCACUGAUCAAUGAAUGCA |
| hsa-miR-181c | 454 | AACCAUCGACCGUUGAGUGGAC | 455 | AACAUUCAACCUGUCGGUGAGU |
| hsa-miR-181d | 456 | CCACCGGGGAUGAAUGUCAC | 457 | AACAUUCAUUGUUGUCGGUGGGU |
| hsa-miR-182 | 458 | UUUGGCAAUGGUAGAACUCACACU | 459 | UGGUUCUAGACUUGCCAACUA |
| hsa-miR-1825 | 460 | UCCAGUGCCCUCCUCUCC | 461 | AGAGGAGGCACUGGAUU |
| hsa-miR-1827 | 462 | UGAGGCAGUAGAUUGAAU | 463 | UCAAUCUACUGCCUCAUU |
| hsa-miR-183 | 464 | UAUGGCACUGGUAGAAUUCACU | 465 | GUGAAUUACCGAAGGGCCAUAA |
| hsa-miR-184 | 466 | UGGACGGAGAACUGAUAAGGGU | 467 | CCUUAUCAGUUCUCCGUCCAUU |
| hsa-miR-185 | 468 | AGGGGCUGGCUUUCCUCUGGUC | 469 | UGGAGAGAAAGGCAGUUCCUGA |
| hsa-miR-186 | 470 | CAAAGAAUUCUCCUUUUGGGCU | 471 | GCCCAAAGGUGAAUUUUUUGGG |
| hsa-miR-187 | 472 | UCGUGUCUUGUGUUGCAGCCGG | 473 | GGCUACAACACAGGACCCGGGC |
| hsa-miR-188 | 474 | CAUCCCUUGCAUGGUGGAGGG | 475 | CUCCCACAUGCAGGGUUUGCA |
| hsa-miR-18a | 476 | UAAGGUGCAUCUAGUGCAGAUAG | 477 | ACUGCCCUAAGUGCUCCUUCUGG |
| hsa-miR-18b | 478 | UAAGGUGCAUCUAGUGCAGUUAG | 479 | UGCCCUAAAUGCCCCUUCUGGC |
| hsa-miR-1908 | 480 | CGGCGGGGACGGCGAUUGGUC | 481 | CCGGCCGCCGGCUCCGCCCCG |
| hsa-miR-1909 | 482 | CGCAGGGGCCGGGUGCUCACCG | 483 | UGAGUGCCGGUGCCUGCCCUG |
| hsa-miR-190a | 484 | UGAUAUGUUUGAUAUAUUAGGU | 485 | CUAUAUAUCAAACAUAUUCCU |
| hsa-miR-190b | 486 | UGAUAUGUUUGAUAUAUUGGGU | 487 | CCCAAUAUCAAACAUAUCAUU |
| hsa-miR-191 | 488 | GCUGCGCUUGGAUUUCGUCCCC | 489 | CAACGGAAUCCCAAAAGCAGCUG |
| hsa-miR-1910 | 490 | CCAGUCCUGUGCCUGCCGCCU | 491 | GAGGCAGAAGCAGGAUGACA |
| hsa-miR-1911 | 492 | CACCAGGCAUUGUGGUCUCC | 493 | UGAGUACCGCCAUGUCUGUUGGG |
| hsa-miR-1912 | 494 | UACCCAGAGCAUGCAGUGUGAA | 495 | CACACUGCACUCUGGGUAUU |
| hsa-miR-1913 | 496 | UCUGCCCCCUCCGCUGCUGCCA | 497 | GCAGCAGCGGAGGGGGCAGAUU |
| hsa-miR-1914 | 498 | CCCUGUGCCCGCCCACUUCUG | 499 | GGAGGGGUCCCGCACUGGGAGG |
| hsa-miR-1915 | 500 | ACCUUGCCUUGCUGCCCGGGCC | 500 | CCCCAGGGCGACGCGGCGGG |
| hsa-miR-192 | 502 | CUGCCAAUUCCAUAGGUCACAG | 501 | CUGACCUAUGAAUUGACAGCC |
| hsa-miR-193a | 504 | UGGGUCUUUGCGGGCGAGAUGA | 505 | AACUGGCCUACAAAGUCCCAGU |
| hsa-miR-193b | 506 | CGGGGUUUUGAGGGCGAGAUGA | 507 | AACUGGCCCUCAAAGUCCCGCU |
| hsa-miR-194 | 508 | UGUAACAGCAACUCCAUGUGGA | 509 | CCAGUGGGGCUGCUGUUAUCUG |
| hsa-miR-195 | 510 | UAGCAGCACAGAAAUAUUGGC | 511 | CCAAUAUUGGCUGUGCUGCUCC |
| hsa-miR-196a | 512 | UAGGUAGUUUCAUGUUGUUGGG | 513 | CGGCAACAAGAAACUGCCUGAG |
| hsa-miR-196b | 514 | UCGACAGCACGACACUGCCUUC | 515 | UAGGUAGUUUCCUGUUGUUGGG |
| hsa-miR-197 | 516 | CGGGUAGAGAGGGCAGUGGGAGG | 517 | UUCACCACCUUCUCCACCCAGC |
| hsa-miR-1972 | 518 | UCAGGCCAGGCACAGUGGCUCA | 519 | AGCCACUGUGCCUGGCCUGAUU |
| hsa-miR-1973 | 520 | ACCGUGCAAAGGUAGCAUA | 521 | UGCUACCUUUGCACGGUUU |
| hsa-miR-1976 | 522 | CCUCCUGCCCUCCUUGCUGU | 523 | AGCAAGGAGGGCAGGAGGUU |
| hsa-miR-198 | 524 | GGUCCAGAGGGGAGAUAGGUUC | 525 | ACCUAUCUCCCCUCUGGACCUU |
| hsa-miR-199a | 526 | ACAGUAGUCUGCACAUUGGUUA | 527 | CCCAGUGUUCAGACUACCUGUUC |
| hsa-miR-199b | 528 | CCCAGUGUUUAGACUAUCUGUUC | 529 | ACAGUAGUCUGCACAUUGGUUA |
| hsa-miR-19a | 530 | UGUGCAAAUCUAUGCAAAACUGA | 531 | AGUUUUGCAUAGUUGCACUACA |
| hsa-miR-19b-1 | 532 | UGUGCAAAUCCAUGCAAAACUGA | 533 | AGUUUUGCAGGUUUGCAUCCAGC |
| hsa-miR-19b-2 | 534 | UGUGCAAAUCCAUGCAAAACUGA | 535 | AGUUUUGCAGGUUUGCAUUUCA |
| hsa-miR-200a | 536 | UAACACUGUCUGGUAACGAUGU | 537 | CAUCUUACCGGACAGUGCUGGA |
| hsa-miR-200b | 538 | CAUCUUACUGGGCAGCAUUGGA | 539 | UAAUACUGCCUGGUAAUGAUGA |
| hsa-miR-200c | 540 | UAAUACUGCCGGGUAAUGAUGGA | 541 | CGUCUUACCCAGCAGUGUUUGG |
| hsa-miR-202 | 542 | UUCCUAUGCAUAUACUUCUUUG | 543 | AGAGGUAUAGGGCAUGGGAA |
| hsa-miR-203a | 544 | AGUGGUUCUUAACAGUUCAACAGUU | 545 | GUGAAAUGUUUAGGACCACUAG |
| hsa-miR-203b | 546 | UAGUGGUCCUAAACAUUUCACA | 547 | UUGACAUGUUAAGAACCACUUA |
| hsa-miR-204 | 548 | GCUGGGAAGGCAAAGGGACGU | 549 | UUCCCUUUGUCAUCCUAUGCCU |
| hsa-miR-205 | 550 | UCCUUCAUUCCACCGGAGUCUG | 551 | GAUUUCAGUGGAGUGAAGUUC |
| hsa-miR-2052 | 552 | UGUUUUGAUAACAGUAAUGU | 553 | AUUACUGUAUCAAAACAUU |
| hsa-miR-2053 | 554 | GUGUUAAUUAAACCUCUAUUUAC | 555 | AAAUAGAGGUUUAAUUAACACUU |
| hsa-miR-2054 | 556 | CUGUAAUAUAAAUUUAAUUAUU | 557 | UAAAUUAAAUUUAUAUUACAGUU |
| hsa-miR-206 | 558 | UGGAAUGUAAGGAAGUGUGUGG | 559 | ACACACUUCCUUACAUUCCAUU |

TABLE 1-continued miRNA Sequences

| miRNA | SEQ ID NO | Sequence 1 | SEQ ID NO | Sequence 2 |
|---|---|---|---|---|
| hsa-miR-208a | 560 | AUAAGACGAGCAAAAAGCUUGU | 561 | GAGCUUUUGGCCCGGGUUAUAC |
| hsa-miR-208b | 562 | AAGCUUUUUGCUCGAAUUAUGU | 563 | AUAAGACGAACAAAAGGUUUGU |
| hsa-miR-20a | 564 | UAAAGUGCUUAUAGUGCAGGUAG | 565 | ACUGCAUUAUGAGCACUUAAAG |
| hsa-miR-20b | 566 | CAAAGUGCUCAUAGUGCAGGUAG | 567 | ACUGUAGUAUGGGCACUUCCAG |
| hsa-miR-21 | 568 | UAGCUUAUCAGACUGAUGUUGA | 569 | CAACACCAGUCGAUGGGCUGU |
| hsa-miR-210 | 570 | AGCCCCUGCCCACCGCACACUG | 571 | CUGUGCGUGUGACAGCGGCUGA |
| hsa-miR-211 | 572 | GCAGGGACAGCAAAGGGGUGC | 573 | UUCCCUUUGUCAUCCUUCGCCU |
| hsa-miR-2110 | 574 | UUGGGGAAACGGCCGCUGAGUG | 575 | CUCAGCGGCCGUUUCCCCAAUU |
| hsa-miR-2113 | 576 | AUUUGUGCUUGGCUCUGUCAC | 577 | GACAGAGCCAAGCACAAAUUU |
| hsa-miR-2114 | 578 | UAGUCCCUUCCUUGAAGCGGUC | 579 | CGAGCCUCAAGCAAGGGACUU |
| hsa-miR-2115 | 580 | CAUCAGAAUUCAUGGAGGCUAG | 581 | AGCUUCCAUGACUCCUGAUGGA |
| hsa-miR-2116 | 582 | GGUUCUUAGCAUAGGAGGUCU | 583 | CCUCCCAUGCCAAGAACUCCC |
| hsa-miR-2117 | 584 | UGUUCUCUUUGCCAAGGACAG | 585 | GUCCUUGGCAAAGAGAACAUU |
| hsa-miR-212 | 586 | UAACAGUCUCCAGUCACGGCC | 587 | ACCUUGGCUCUAGACUGCUUACU |
| hsa-miR-214 | 588 | UGCCUGUCUACACUUGCUGUGC | 589 | ACAGCAGGCACAGACAGGCAGU |
| hsa-miR-215 | 590 | UCUGUCAUUUCUUUAGGCCAAUA | 591 | AUGACCUAUGAAUUGACAGAC |
| hsa-miR-216a | 592 | UAAUCUCAGCUGGCAACUGUGA | 593 | UCACAGUGGUCUCUGGGAUUAU |
| hsa-miR-216b | 594 | AAAUCUCUGCAGGCAAAUGUGA | 595 | ACACACUUACCCGUAGAGAUUCUA |
| hsa-miR-217 | 596 | UACUGCAUCAGGAACUGAUUGGA | 597 | CAAUCAGUUCCUGAUGCAGUAUU |
| hsa-miR-218-1 | 598 | UUGUGCUUGAUCUAACCAUGU | 599 | AUGGUUCCGUCAAGCACCAGGG |
| hsa-miR-218-2 | 600 | UUGUGCUUGAUCUAACCAUGU | 601 | CAUGGUUCUGUCAAGCACCGCG |
| hsa-miR-219a-1 | 602 | UGAUUGUCCAAACGCAAUUCU | 603 | AGAGUUGAGUCUGGACGUCCCG |
| hsa-miR-219a-2 | 604 | UGAUUGUCCAAACGCAAUUCU | 605 | AGAAUUGUGGCUGGACAUCUGU |
| hsa-miR-219b | 606 | AGAAUGUCCAGCCACAAUUCUCG | 607 | AGAAUUGCGUUUGGACAACAGU |
| hsa-miR-22 | 608 | AGUUCUUCAGUGGCAAGCUUUA | 609 | AAGCUGCCAGUUGAAGAACUGU |
| hsa-miR-221 | 610 | AGCUACAUUGUCUGCUGGGUUUC | 611 | ACCUGGCAUACAAUGUAGAUUU |
| hsa-miR-222 | 612 | AGCUACAUCUGGCUACUGGGU | 613 | CUCAGUAGCCAGUGUAGAUCCU |
| hsa-miR-223 | 614 | CGUGUAUUUGACAAGCUGAGUU | 615 | UGUCAGUUUGUCAAAUACCCCA |
| hsa-miR-224 | 616 | AAAAUGGUGCCCUAGUGACUACA | 617 | CAAGUCACUAGUGGUUCCGUU |
| hsa-miR-2276 | 618 | GCCCUCUGUCACCUUGCAGACG | 619 | UCUGCAAGUGUCAGAGGCGAGG |
| hsa-miR-2277 | 620 | AGCGCGGGCUGAGCGCUGCCAGUC | 621 | UGACAGCGCCCUGCCUGGCUC |
| hsa-miR-2278 | 622 | GAGAGCAGUGUGUGUUGCCUGG | 623 | AGGCAACACACACUGCUCUCUU |
| hsa-miR-2355 | 624 | AUCCCCAGAUACAAUGGACAA | 625 | AUUGUCUGUGCUGUUUGGAGAU |
| hsa-miR-2392 | 626 | UAGGAUGGGGGUGAGAGGUG | 627 | CCUCUCACCCCCAUCCUAUU |
| hsa-miR-23a | 628 | AUCACAUUGCCAGGGAUUUCC | 629 | GGGGUUCCUGGGGAUGGGAUUU |
| hsa-miR-23b | 630 | AUCACAUUGCCAGGGAUUACC | 631 | UGGGUUCCUGGCAUGCUGAUUU |
| hsa-miR-23c | 632 | AUCACAUUGCCAGUGAUUACCC | 633 | GUAAUCACCAAGUGAUUUCUCC |
| hsa-miR-24-1 | 634 | UGGCUCAGUUCAGCAGGAACAG | 635 | UGCCUACUGAGCUGAUAUCAGU |
| hsa-miR-24-2 | 636 | UGGCUCAGUUCAGCAGGAACAG | 637 | UGCCUACUGAGCUGAAACACAG |
| hsa-miR-2467 | 638 | AGCAGAGGCAGAGAGGCUCAGG | 639 | UGAGGCUCUGUUAGCCUUGGCUC |
| hsa-miR-25 | 640 | AGGCGGAGACUUGGGCAAUUG | 641 | CAUUGCACUUGUCUCGGUCUGA |
| hsa-miR-2681 | 642 | GUUUUACCACCUCCAGGAGACU | 643 | UAUCAUGGAGUUGGUAAAGCAC |
| hsa-miR-2682 | 644 | CGCCUCUUCAGCGCUGUCUUCC | 645 | CAGGCAGUGACUGUUCAGACGU |
| hsa-miR-26a-1 | 645 | UUCAAGUAAUCCAGGAUAGGCU | 647 | CCUAUUCUUGGUUACUUGCACG |
| hsa-miR-26a-2 | 648 | UUCAAGUAAUCCAGGAUAGGCU | 649 | CCUAUUCUUGGUUAUCUUGGCUC |
| hsa-miR-26b | 650 | UUCAAGUAAUUCAGGAUAGGU | 651 | CCUGUUCUCCAUUACUUGGCUC |
| hsa-miR-27a | 652 | UUCACAGUGGCUAAGUUCCGC | 653 | AGGGCUUAGCUGCUUGUGAGCA |
| hsa-miR-27b | 654 | UUCACAGUGGCUAAGUUCUGC | 655 | AGAGCUUAGCUGAUUGGUGAAC |
| hsa-mmiRR-28 | 656 | CACUAGAUUGUGAGCUCCUGGA | 657 | AAGGAGCACAGUCUAUUGAG |
| hsa-miR-2861 | 658 | GGGGCCUGGCGGUGGGCGG | 659 | GCCCACCGCCAGGCCCCUU |
| hsa-miR-2909 | 660 | GUUAGGGCCAACAUCUCUUGG | 661 | AAGAGAUGUUGGCCCUAACUU |
| hsa-miR-296 | 662 | GAGGGUUGGGUGGAGGCUCUCC | 663 | AGGGCCCCCCCUCAAUCCUGU |
| hsa-miR-297 | 664 | AUGUAUGUGUGCAUGUGCAUG | 665 | UGCACAUGCACACAUACAUUU |
| hsa-miR-298 | 666 | AGCAGAAGCAGGGAGGUUCUCCCA | 667 | GGAGAACCUCCCUGCUUCUGCUUU |
| hsa-miR-299 | 668 | UGGUUUACCGUCCCACAUACAU | 669 | UAUGUGGGAUGGUAAACCGCUU |
| hsa-miR-29a | 670 | ACUGAUUUCUUUUGGUGUUCAG | 671 | UAGCACCAUCUGAAAUCGGUUA |
| hsa-miR-29b-1 | 672 | UAGCACCAUUUGAAAUCAGUGUU | 673 | GCUGGUUUCAUAUGGUGGUUUAGA |
| hsa-miR-29b-2 | 674 | UAGCACCAUUUGAAAUCAGUGUU | 675 | CUGGUUUCACAUGGUGGCUUAG |
| hsa-miR-29c | 676 | UGACCGAUUUCUCCUGGUGUUC | 677 | UAGCACCAUUUGAAAUCGGUUA |
| hsa-miR-300 | 678 | UAUACAAGGGCAGACUCUCUCU | 679 | AGAGAGUCUGCCCUUGUAUU |
| hsa-miR-301a | 680 | GCUCUGACUUUAUUGCACUACU | 681 | CAGUGCAAUAGUAUUGUCAAAGC |
| hsa-miR-301b | 682 | CAGUGCAAUGAUAUUGUCAAAGC | 683 | GCUCUGACGAGGUUGCACUACU |
| hsa-miR-302a | 684 | UAAGUGCUUCCAUGUUUUGGUGA | 685 | ACUUAAACGUGGAUGUACUUGCU |
| hsa-miR-302b | 686 | UAAGUGCUUCCAUGUUUUAGUAG | 687 | ACUUUAACAUGGAAGUGCUUUC |
| hsa-miR-302c | 688 | UUUAACAUGGGGGUACCUGCUG | 689 | UAAGUGCUUCCAUGUUUCAGUGG |
| hsa-miR-302d | 690 | ACUUUAACAUGGAGGCACUUGC | 691 | UAAGUGCUUCCAUGUUUGAGUGU |
| hsa-miR-302e | 692 | UAAGUGCUUCCAUGCUU | 693 | GCAUGGAAGCACUUAUU |
| hsa-miR-302f | 694 | UAAUUGCUUCCAUGUUU | 695 | ACAUGGAAGCAAUAUU |
| hsa-miR-3064 | 696 | UUGCCACACUGCAACACCUUACA | 697 | UCUGGCUGUUGGGUGUGCAA |
| hsa-miR-3065 | 698 | UCAGCACCAGGAUAUUGUUGGAG | 699 | UCAACAAAAAUCACUGAUGCUGGA |
| hsa-miR-3074 | 700 | GAUAUCAGCUCAGUAGGCACCG | 701 | GUUCCUGCUGAACUGAGCCAG |
| hsa-miR-30a | 702 | CUUUCAGUCGGAUGUUUGCAGC | 703 | UGUAAACAUCCUCGACUGGAAG |
| hsa-miR-30b | 704 | UGUAAACAUCCUACACUCAGCU | | CUGGGAGGUGGAUGUUUACUUC |
| hsa-miR-30c-1 | 706 | UGUAAACAUCCUACACUCUCAGC | 705 | CUGGGAGAGGGUUGUUUACUCC |
| hsa-miR-30c-2 | 708 | UGUAAACAUCCUACACUCUCAGC | 707 | CUGGGAGAAGGCUGUUUACUCU |

TABLE 1-continued miRNA Sequences

| miRNA | SEQ ID NO | Sequence 1 | SEQ ID NO | Sequence 2 |
|---|---|---|---|---|
| hsa-miR-30d | 710 | UGUAAACAUCCCCGACUGGAAG | 709 | CUUUCAGUCAGAUGUUUGCUGC |
| hsa-miR-30e | 712 | UGUAAACAUCCUUGACUGGAAG | 711 | CUUUCAGUCGGAUGUUUACAGC |
| hsa-miR-31 | 714 | UGCUAUGCCAACAUAUUGCCAU | 713 | AGGCAAGAUGCUGGCAUAGCU |
| hsa-miR-3115 | 716 | AUAUGGGUUUACAUAGUUGGU | 715 | CAACUAGUAAACCCAUAUUU |
| hsa-miR-3116 | 718 | UGCCUGGAACUAGUAGGGACU | 717 | UCCCUACUAUGUUCCAGGCAUU |
| hsa-miR-3117 | 720 | AUAGGACUCAUAUAGUGCCAG | 719 | AGACACUAUACGAGUCAUAU |
| hsa-miR-3118 | 722 | UGUGACUGCAUUAUGAAAAUUCU | 721 | AAUUUUCAUAAUGCAGUCACAUU |
| hsa-miR-3119 | 724 | UGGCUUUUAACUUUGAUGGC | 723 | CAUCAAAGUUAAAAGCCAUU |
| hsa-miR-3120 | 726 | CCUGUCUGUGCCUGCUGUACA | 725 | CACAGCAAGUGUAGACAGGCA |
| hsa-miR-3121 | 728 | UCCUUUGCCUAUUCUAUUUAAG | 727 | UAAAUAGAGUAGGCAAAGGACA |
| hsa-miR-3122 | 730 | GUUGGGACAAGAGGACGGUCUU | 729 | GACCGUCCUCUUGUCCCAACUU |
| hsa-miR-3123 | 732 | CAGAGAAUUGUUUAAUC | 731 | UUAAACAAUUCUCUGUU |
| hsa-miR-3124 | 734 | UUCGCGGGCGAAGGCAAAGUC | 733 | ACUUUCCUCACUCCCGUGAAGU |
| hsa-miR-3125 | 736 | UAGAGGAAGCUGUGGAGAGA | 735 | UCUCCACAGCUUCCUCUAUU |
| hsa-miR-3126 | 738 | CAUCUGGCAUCCGUCACACAGA | 737 | UGAGGGACAGAUGCCAGAAGCA |
| hsa-miR-3127 | 740 | UCCCCUUCUGCAGGCCUGCUGG | 739 | AUCAGGGCUUGUGUGGAAUGGGAAG |
| hsa-miR-3128 | 742 | UCUGGCAAGUAAAAAACUCUCAU | 741 | GAGAGUUUUUUACUUGCCAGAUU |
| hsa-miR-3129 | 744 | GCAGUAGUGUAGAGAUUGGUUU | 743 | AAACUAAUCUCUACACUGCUGC |
| hsa-miR-3130 | 746 | GCUGCACCGGAGACUGGGUAA | 745 | UACCCAGUCUCCGGUGCAGCC |
| hsa-miR-3131 | 748 | UCGAGGACUGGUGGAAGGGCCUU | 747 | GGCCCUUCCACCAGUCCUCGAUU |
| hsa-miR-3132 | 750 | UGGGUAGAGAAGGAGCUCAGAGGA | 749 | CUCUGAGCUCCUUCUCUACCCAUU |
| hsa-miR-3133 | 752 | UAAGAACUCUUAAAACCCAAU | 751 | UGGGUUUUAAGAGUUCUUAUU |
| hsa-miR-3134 | 754 | UGAUGGAUAAAAGACUACAUAUU | 753 | UAUGUAGUCUUUUAUCCAUCAUU |
| hsa-miR-3135a | 756 | UGCCUAGGCUGAGACUGCAGUG | 755 | CUGCAGUCUCAGCCUAGGCAUU |
| hsa-miR-3135b | 758 | GGCUGGAGCGAGUGCAGUGGUG | 759 | CCACUGCACUCGCUCCAGCCUU |
| hsa-miR-3136 | 760 | CUGACUGAAUAGGUAGGGUCAUU | 761 | UGGCCCAACCUAUUCAGUUAGU |
| hsa-miR-3137 | 762 | UCUGUAGCCUGGGAGCAAUGGGGU | 763 | CCCAUUGCUCCCAGGCUACAGAUU |
| hsa-miR-3138 | 764 | UGUGGACAGUGAGGUAGAGGGAGU | 765 | UCCCUCUACCUCACUGUCCACAUU |
| hsa-miR-3139 | 766 | UAGGAGCUCAACAGAUGCCUGUU | 767 | CAGGCAUCUGUUGAGCUCCUAUU |
| hsa-miR-3140 | 768 | ACCUGAAUUACCAAAAGCUUU | 769 | AGCUUUGGGAAUUCAGGUAGU |
| hsa-miR-3141 | 770 | GAGGGCGGGUGGAGGAGGA | 771 | CUCCUCCACCCGCCCUCUU |
| hsa-miR-3142 | 772 | AAGGCCUUUCUGAACCUUCAGA | 773 | UGAAGGUUCAGAAAGGCCUUUU |
| hsa-miR-3143 | 774 | AUAACAUUGUAAAGCGCUUCUUUCG | 775 | AAAAGAAGCGCUUUACAAUGUUAUUU |
| hsa-miR-3144 | 776 | AUAUACCUGUUCGGUCUCUUUA | 777 | AGGGGACCAAAGAGAUAUAUAG |
| hsa-miR-3145 | 778 | AGAUAUUUUGAGUGUUUGGAAUUG | 779 | AACUCCAAACACUCAAAACUCA |
| hsa-miR-3146 | 780 | CAUGCUAGGAUAGAAAGAAUGG | 781 | AUUCUUUCUAUCCUAGCAUGUU |
| hsa-miR-3147 | 782 | GGUUGGGCAGUGAGGAGGGUGUGA | 783 | ACACCCUCCUCACUGCCCAACCUU |
| hsa-miR-3148 | 784 | UGGAAAAACUGGUGUGUGCUU | 785 | GCACACACCAGUUUUUUCCAUU |
| hsa-miR-3149 | 786 | UUUGUAUGGAUAUGUGUGUGUAU | 787 | ACACACACAUAUCCAUACAAAUU |
| hsa-miR-3150a | 788 | CAACCUCGACGAUCUCCUCAGC | 789 | CUGGGGAGAUCCUCGAGGUUGG |
| hsa-miR-3150b | 790 | CAACCUCGAGGAUCUCCCCUGGC | 791 | UGAGGAGAUCCUCGAGGUUGG |
| hsa-miR-3151 | 792 | GGUGGGGCAAUGGGAUCAGGU | 793 | CCUGAUCCCACAGCCCACCU |
| hsa-miR-3152 | 794 | AUUGCCUCUGUUCUAACACAAG | 795 | UGUGUUAGAAUAGGGGCAAUAA |
| hsa-miR-3153 | 796 | GGGGAAAGCGAGUAGGGACAUUU | 797 | AUGUCCUACUCGCUUUCCCCUU |
| hsa-miR-3154 | 798 | CAGAAGGGGAGUUUGGGAGCAGA | 799 | UGCUCCCAACUCCCCUUCUGUU |
| hsa-miR-3155a | 800 | CCAGGCUCUGCAGUGGGAACU | 801 | UUCCACUGCAGAGCCUGGUU |
| hsa-miR-3155b | 802 | CCAGGCUCUGCAGUGGGA | 803 | CCACUGCAGAGCCUGGUU |
| hsa-miR-3156 | 804 | CUCCCACUUCCAGAUCUUUCU | 805 | AAAGAUCUGGAAGUGGGAGACA |
| hsa-miR-3157 | 806 | CUGCCCUAGUCUAGCUGAAGCU | 807 | UUCAGCUAGCUAGUGCAGUCU |
| hsa-miR-3158 | 808 | AAGGGCUUCCUCUCUGCAGGAC | 809 | CCUGCAGAGAGGAAGCCCUUC |
| hsa-miR-3159 | 810 | UAGGAUUACAAGUGUCGGCCAC | 811 | GGCCGACACUUGUAAUCCUAUU |
| hsa-miR-3160 | 812 | AGAGCUGAGACUAGAAAGCCCA | 813 | GGCUUUCUAGUCUCAGCUCCC |
| hsa-miR-3161 | 814 | CUGAUAAGAACAGAGGCCCAGAU | 815 | CUGGGCCUCUGUUCUUAUCAGUU |
| hsa-miR-3162 | 816 | UUAGGGAGUAGAAGGGUGGGGAG | 817 | UCCCUACCCCUCCACUCCCCA |
| hsa-miR-3163 | 818 | UAUAAAAUGAGGGCAGUAAGAC | 819 | CUUACUGCCCUCAUUUUAUAUU |
| hsa-miR-3164 | 820 | UGUGACUUUAAGGGAAAUGGCG | 821 | CCAUUUCCCUUAAAGUCACAUU |
| hsa-miR-3165 | 822 | AGGUGGAUGCAAUGUGACCUCA | 823 | AGGUCACAUUGCAUCCACCUUU |
| hsa-miR-3166 | 824 | CGCAGACAAUGCCUACUGCCUA | 825 | GGCAGUAGGCAUUGUCUGCGUU |
| hsa-miR-3167 | 826 | AGGAUUUCAGAAAUACUGGUGU | 827 | ACCAGUAUUUCUGAAAUCCUUU |
| hsa-miR-3168 | 828 | GAGUUCUACAGUCAGAC | 829 | CUGACUGUAGAACUCUU |
| hsa-miR-3169 | 830 | UAGGACUGUGCUUGGCACAUAG | 831 | AUGUGCCAAGCACAGUCCUAUU |
| hsa-miR-3170 | 830 | CUGGGGUUCUGAGACAGACAGU | 833 | UGUCUGUCUCAGAACCCCAGU |
| hsa-miR-3171 | 834 | AGAUGUAUGGAAUCUGUAUAUAUC | 835 | UAUAUACAGAUUCCAUACAUCUUU |
| hsa-miR-3173 | 836 | AAAGGAGGGAAAUAGGCAGGCCA | 837 | UGCCCUGCCUGUUUUCUCCUUU |
| hsa-miR-3174 | 838 | UAGUGAGUUAGAGAUGCAGAGCC | 839 | CUCUGCAUCUCUAACUCACUAUU |
| hsa-miR-3175 | 840 | CGGGGAGAGAACCAGUGACGU | 841 | GUCACUGGUUCUCUCCCCGUU |
| hsa-miR-3176 | 842 | ACUGGCCUGGGACUACCGG | 843 | GGUAGUCCCAGGCCAGUUU |
| hsa-miR-3177 | 844 | UGUGUACACACGUGCCAGGCGCU | 845 | UGCACGGCACUGGGGACACGU |
| hsa-miR-3178 | 846 | GGGGCGCGGCCGGAUCG | 847 | AUCCGGCCGCGCCCCUU |
| hsa-miR-3179 | 848 | AGAAGGGGUGAAAUUUAAACGU | 849 | GUUUAAAUUUCACCCCUUCUUU |
| hsa-miR-3180 | 850 | CUUCCAGACGCUCCGCCCCACGUCG | 851 | UGGGGCGGAGCUUCCGGAGGCC |
| hsa-miR-3181 | 852 | AUCGGGCCCUCGGCGCCGG | 853 | GGCGCCGAGGGCCCGAUUU |
| hsa-miR-3182 | 854 | GCUUCUGUAGUGUAGUC | 855 | CUACACUACAGAAGCUU |
| hsa-miR-3183 | 856 | GCCUCUCUCGGAGUCGCUCGGA | 857 | CGAGCGACUCCGAGAGAGGCUU |
| hsa-miR-3184 | 858 | AAAGUCUCGCUCUCUGCCCCUCA | 859 | UGAGGGGCCUCAGACCGAGCUUUU |

TABLE 1-continued miRNA Sequences

| miRNA | SEQ ID NO | Sequence 1 | SEQ ID NO | Sequence 2 |
|---|---|---|---|---|
| hsa-miR-3185 | 860 | AGAAGAAGGCGUCGGUCUGCGG | 861 | GCAGACCGACCGCCUUCUUCUUU |
| hsa-miR-3186 | 862 | CAGGCGUCUGUCUACGUGGCUU | 863 | UCACGCGGAGAGAUGGCUUUG |
| hsa-miR-3187 | 864 | UUGGGCCAUGGGGCUGCGCGG | 865 | CCUGGGCAGCGUGUGGCUGAAGG |
| hsa-miR-3188 | 866 | AGAGGCUUUGUGCGGAUACGGGG | 867 | CCGUAUCCGCACAAAGCCUCUUU |
| hsa-miR-3189 | 868 | CCCUUGGGUCUGAUGGGGUAG | 869 | UGCCCCAUCUGUGCCCUGGGUAGGA |
| hsa-miR-3190 | 870 | UGUGGAAGGUAGACGGCCAGAGA | 871 | UCUGGCCAGCUACGUCCCCA |
| hsa-miR-3191 | 872 | CUCUCUGGCCGUCUACCUUCCA | 873 | UGGGGACGUAGCUGGCCAGACAG |
| hsa-miR-3192 | 874 | UCUGGGAGGUUGUAGCAGUGGAA | 875 | CUCUGAUCGCCCUCUCAGCUC |
| hsa-miR-3193 | 876 | UCCUGCGUAGGAUCUGAGGAGU | 877 | UCCUCAGAUCCUACGCAGGAUU |
| hsa-miR-3194 | 878 | AGCUCUGCUGCUCACUGGCAGU | 879 | GGCCAGCCACCAGGAGGGCUG |
| hsa-miR-3195 | 880 | CGCGCCGGGCCCGGGUU | 881 | CCCGGGCCCGGCGCGUU |
| hsa-miR-3196 | 882 | CGGGGCGGCAGGGGCCUC | 883 | GGCCCCUGCCGCCCCGUU |
| hsa-miR-3197 | 884 | GGAGGCGCAGGCUCGGAAAGGCG | 885 | CCUUUCCGAGCCUGCGCCUCCUU |
| hsa-miR-3198 | 886 | GUGGAGUCCUGGGGAAUGGAGA | 887 | UCCAUCCCCAGGACUCCACUU |
| hsa-miR-3199 | 888 | AGGGACUGCCUUAGGAGAAAGUU | 889 | CUUUCUCCUAAGGCAGUCCCUUU |
| hsa-miR-32 | 890 | CAAUUUAGUGUGUGUGAUAUUU | 891 | UAUUGCACAUUACUAAGUUGCA |
| hsa-miR-3200 | 892 | CACCUUGCGCUACUCAGGUCUG | 893 | AAUCUGAGAAGGCGCACAAGGU |
| hsa-miR-3201 | 894 | GGGAUAUGAAGAAAAAU | 895 | UUUUCUUCAUAUCCCUU |
| hsa-miR-3202 | 896 | UGGAAGGGAGAAGAGCUUUAAU | 897 | UAAAGCUCUUCUCCCUUCCAUU |
| hsa-miR-320a | 888 | AAAAGCUGGGUUGAGAGGGCGA | 899 | GCCCUCUCAACCCAGCUUUUUU |
| hsa-miR-320b | 900 | AAAAGCUGGGUUGAGAGGGCAA | 901 | GCCCUCUCAACCCAGCUUUUUU |
| hsa-miR-320c | 902 | AAAAGCUGGGUUGAGAGGGU | 903 | CCUCUCAACCCAGCUUUUUU |
| hsa-miR-320d | 904 | AAAAGCUGGGUUGAGAGGA | 905 | CUCUCAACCCAGCUUUUUU |
| hsa-miR-320e | 906 | AAGGCUGGGUUGAGAAGG | 907 | UUCUCAACCCAGCUUUUU |
| hsa-miR-323a | 908 | AGGUGGUCCGUGGCGCGUUCGC | 909 | CACAUUACACGGUCGACCUCU |
| hsa-miR-323b | 910 | AGGUUGUCCGUGGUGAGUUCGCA | 911 | CCCAAUACACGGUCGACCUCUU |
| hsa-miR-324 | 912 | CGCAUCCCCUAGGGCAUUGGUGU | 913 | ACUGCCCCAGGUGCUGCUGG |
| hsa-miR-325 | 914 | CCUAGUAGGUGUCCAGUAAGUGU | 915 | ACUACUGGAGACACCUACUAGGUU |
| hsa-miR-326 | 916 | CCUCUGGGCCCUUCCUCCAG | 917 | GGAGGAAGGGCCCAGAGGUU |
| hsa-miR-328 | 918 | CUGGCCCUCUCUGCCCUUCCGU | 919 | GGGGGGGCAGGAGGGGCUCAGGG |
| hsa-miR-329 | 920 | AACACACCUGGUUAACCUCUUU | 921 | GAGGUUUUCUGGGUUUCUGUUUC |
| hsa-miR-330 | 922 | GCAAAGCACACGGCCUGCAGAGA | 923 | UCUCUGGGCCUGUGUCUUAGGC |
| hsa-miR-331 | 924 | CUAGGUAUGGUCCCAGGGAUCC | 925 | GCCCCUGGGCCUAUCCUAGAA |
| hsa-miR-335 | 926 | UCAAGAGCAAUAACGAAAAAUGU | 927 | UUUUUCAUUAUUGCUCCUGACC |
| hsa-miR-337 | 928 | GAACGGCUUCAUACAGGAGUU | 929 | CUCCUAUAUGAUGCCUUUCUUC |
| hsa-miR-338 | 930 | UCCAGCAUCAGUGAUUUUGUUG | 931 | AACAAUAUCCUGGUGCUGAGUG |
| hsa-miR-339 | 932 | UGAGCGCCUCGACGACAGAGCCG | 933 | UCCCUGUCCUCCAGGAGCUCACG |
| hsa-miR-33a | 934 | GUGCAUUGUAGUUGCAUUGCA | 935 | CAAUGUUUCCACAGUGCAUCAC |
| hsa-miR-33b | 934 | GUGCAUUGCUGUUGCAUUGC | 937 | CAGUGCCUCGGCAGUGCAGCCC |
| hsa-miR-340 | 938 | UCCGUCUCAGUUACUUUAUAGC | 939 | UUAUAAAGCAAUGAGACUGAUU |
| hsa-miR-342 | 940 | UCUCACACAGAAAUCGCACCCGU | 941 | AGGGGUGCUAUCUGUGAUUGA |
| hsa-miR-345 | 942 | GCCCUGAACGAGGGGUCUGGAG | 943 | GCUGACUCCUAGUCCAGGGCUC |
| hsa-miR-346 | 944 | UGUCUGCCCGCAUGCCUGCCUCU | 945 | AGGCAGGCAUGCGGGCAGACAUU |
| hsa-miR-34a | 946 | UGGCAGUGUCUUAGCUGGUUGU | 947 | CAAUCAGCAAGUAUACUGCCCU |
| hsa-miR-34b | 948 | UAGGCAGUGUCAUUAGCUGAUUG | 949 | CAAUCACUAACUCCACUGCCAU |
| hsa-miR-34c | 950 | AAUCACUAACCACACGGCCAGG | 951 | AGGCAGUGUAGUUAGCUGAUUGC |
| hsa-miR-3529 | 952 | AACAACAAAAUCACUAGUCUUCCA | 953 | AGGUAGACUGGGAUUGUUGUU |
| hsa-miR-3591 | 954 | AAACACCAUUGUCACACUCCAC | 955 | UUUAGUGUGAUAAUGGCGUUUGA |
| hsa-miR-3605 | 956 | CCUCCGUGUUACCUGUCCUCUAG | 957 | UGAGGAUGUAGCAAGGAAGCC |
| hsa-miR-3606 | 958 | UUAGUGAAGGCUAUUUUAAUU | 959 | AAAAUUUCUUUCACUACUUAG |
| hsa-miR-3607 | 960 | ACUGUAAACGCUUUCUGAUG | 961 | GCAUGUGAUGAAGCAAAUCAGU |
| hsa-miR-3609 | 962 | CAAAGUGAUGAGUAAUACUGGCUG | 963 | GCCAGUAUUACUCAUCACUUUGUU |
| hsa-miR-361 | 964 | UCCCCCAGGUGUGAUUCUGAUUU | 965 | UUAUCAGAAUCUCCAGGGGUAC |
| hsa-miR-3610 | 966 | GAAUCGAAAGGAGGCGCCG | 967 | GCGCCUCCUUUCCGAUUCUU |
| hsa-miR-3611 | 968 | UUGUGAAGAAAGAAAUUCUUA | 969 | AGAAUUUCUUUCUUCACAAUU |
| hsa-miR-3612 | 970 | AGGAGGCAUCUUGAGAAAUGGA | 971 | CAUUUCUCAAGAUGCCUCCUUU |
| hsa-miR-3613 | 972 | UGUUGUACUUUUUUUUUUGUUC | 973 | ACAAAAAAAAAGCCCAACCCUUC |
| hsa-miR-3614 | 974 | CCACUUGGAUCUGAAGGCUGCCC | 975 | UAGCCUUCAGAUCUUGGUGUUU |
| hsa-miR-3615 | 976 | UCUCUCGGCUCCUCGCGGCUC | 977 | GCCGCGAGGAGCCGAGAGAUU |
| hsa-miR-3616 | 978 | AUGAAGUGCACUCAUGAUAUGU | 979 | CGAGGGCAUUUCAUGAUGCAGGC |
| hsa-miR-3617 | 980 | CAUCAGCACCCUAUGUCCUUUCU | 981 | AAAGACAUAGUUGCAAGAUGGG |
| hsa-miR-3618 | 982 | UGUCUACAUUAAUGAAAAGAGC | 983 | UCUUUUCAUUAAUGUAGACAUU |
| hsa-miR-3619 | 984 | UCAGCAGGCAGGCUGGUGCAGC | 985 | GGGACCAUCCUGCUGCUGUGG |
| hsa-miR-362 | 986 | AACACACCUAUUCAAGGAUUCA | 987 | AAUCCUUGAACCUAGGUGUGAGU |
| hsa-miR-3620 | 988 | UCACCCUGCAUCCCGCACCCAG | 989 | GUGGGCUGGGCUGGGCUGGGCC |
| hsa-miR-3621 | 990 | CGCGGGUCGGGGUCUGCAGG | 991 | UGCAGACCCGACCCGCGUU |
| hsa-miR-3622a | 992 | UCACCUGACCUCCCAUGCCUGU | 993 | CAGGCACGGGAGCUCAGGUGAG |
| hsa-miR-3622b | 994 | UCACCUGAGCUCCCGUGCCUG | 995 | AGGCAUGGGAGGUCAGGUGA |
| hsa-miR-363 | 996 | AAUUGCACGGUAUCCAUCUGUA | 997 | CGGGUGGAUCACGAUGCAAUUU |
| hsa-miR-3646 | 998 | AAAAUGAAAUGAGCCCAGCCCA | 999 | GGCUGGGCACUUUCAUUUUUU |
| hsa-miR-3648 | 1000 | AGCCGCGGGAUCGCCGAGGG | 1001 | CUCCGCGAUCCCCGCGGCUUU |
| hsa-miR-3649 | 1002 | AGGGACCUGAGUGUCUAAG | 1003 | UAGACACUCAGGUCCCUUU |
| hsa-miR-3650 | 1004 | AGGUGUGUCUGUAGAGUCC | 1005 | ACUCUACAGACACACCUUU |
| hsa-miR-3651 | 1006 | CAUAGCCCGGUCGCUGGUACAUGA | 1007 | AUGUACCAGCGACCGGGCUAUGUU |
| hsa-miR-3652 | 1008 | CGGCUGGAGGUGUGAGGA | 1009 | CUCACACCUCCAGCCGUU |

TABLE 1-continued miRNA Sequences

| miRNA | SEQ ID NO | Sequence 1 | SEQ ID NO | Sequence 2 |
|---|---|---|---|---|
| hsa-miR-3653 | 1010 | CCUCCUGAUGAUUCUUCUUC | 1011 | CUAAGAAGUUGACUGAAG |
| hsa-miR-3654 | 1012 | GACUGGACAAGCUGAGGAA | 1013 | CCUCAGCUUGUCCAGUCUU |
| hsa-miR-3655 | 1014 | GCUUGUCGCUGCGGUGUUGCU | 1015 | CAACACCGCAGCGACAAGCUU |
| hsa-miR-3656 | 1016 | GGCGGGUGCGGGGUGG | 1017 | ACCCCCGCACCCGCCUU |
| hsa-miR-3657 | 1018 | UGUGUCCCAUUAUUGGUGAUU | 1019 | UCACCAAUAAUGGGACACAUU |
| hsa-miR-3658 | 1020 | UUUAAGAAAACACCAUGGAGAU | 1021 | CUCCAUGGUGUUUUCUUAAAUU |
| hsa-miR-3659 | 1022 | UGAGUGUUGUCUACGAGGGCA | 1023 | CCCUCGUAGACAACACUCAUU |
| hsa-miR-365a | 1024 | UAAUGCCCCUAAAAAUCCUUAU | 1025 | AGGGACUUUUGGGGCAGAUGUG |
| hsa-miR-365b | 1026 | UAAUGCCCCUAAAAAUCCUUAU | 1027 | AGGGACUUUCAGGGGCAGUGU |
| hsa-miR-3660 | 1028 | ACUGACAGGAGAGCAUUUUGA | 1029 | AAAAUGCUCUCCUGUCAGUUU |
| hsa-miR-3661 | 1030 | UGACCUGGGACUCGGACAGCUG | 1031 | GCUGUCCGAGUCCCAGGUCAUU |
| hsa-miR-3662 | 1032 | GAAAAUGAUGAGUAGUGACUGAUG | 1033 | UCAGUCACUACUCAUCAUUUUCUU |
| hsa-miR-3663 | 1034 | UGAGCACCACACAGGCCGGGCGC | 1035 | GCUGGUCUGCGUGGUGCUCGG |
| hsa-miR-3664 | 1036 | UCUCAGGAGUAAAGACAGAGUU | 1037 | AACUCUGUCUUCACUCAUGAGU |
| hsa-miR-3665 | 1038 | AGCAGGUGCGGGGCGGCG | 1039 | CCGCCCCGCACCUGCUUU |
| hsa-miR-3666 | 1040 | CAGUGCAAGUGUAGAUGCCGA | 1041 | GGCAUCUACACUUGCACGUU |
| hsa-miR-3667 | 1042 | ACCUUCCUCUCCAUGGGUCUUU | 1043 | AAAGACCCAUUGAGGAGAAGGU |
| hsa-miR-3668 | 1044 | AAUGUAGAGAUUGAUCAAAAU | 1045 | UUUGAUCAAUCUCUACAUUUU |
| hsa-miR-367 | 1046 | AAUUGCACUUUAGCAAUGGUGA | 1047 | ACUGUUGCUAAUAUGCAACUCU |
| hsa-miR-3670 | 1048 | AGAGCUCACAGCUGUGUCCUUCUCUA | 1049 | GAGAAGGACAGCUGUGAGCUCUUU |
| hsa-miR-3671 | 1050 | AUCAAAUAAGGACUAGUCUGCA | 1051 | CAGACUAGUCCUUAUUUGAUUU |
| hsa-miR-3672 | 1052 | AUGAGACUCAUGUAAAACAUCUU | 1053 | GAUGUUUUACAUGAGUCUCAUUU |
| hsa-miR-3674 | 1054 | AUUGUAGAACCUAAGAUUGGCC | 1055 | CCAAUCUUAGGUUCUACAAUUU |
| hsa-miR-3675 | 1056 | CAUCUCUAAGGAACUCCCCCAA | 1057 | UAUGGGGCUUCUGUAGAGAUUUC |
| hsa-miR-3677 | 1058 | CAGUGGCCAGAGCCCUGCAGUG | 1059 | CUCGUGGGCUCUGGCCACGGCC |
| hsa-miR-3678 | 1060 | CUGCAGAGUUUGUACGGACCGG | 1061 | UCCGUACAAACUCUGCUGUG |
| hsa-miR-3679 | 1062 | CUUCCCCCCAGUAAUCUUCAUC | 1063 | UGAGGAUAUGGCAGGGAAGGGA |
| hsa-miR-3680 | 1064 | GACUCACUCACAGGAUUGUGCA | 1065 | UUUUGCAUGACCCUGGGAGUAGG |
| hsa-miR-3681 | 1066 | UAGUGGAUGAUGCACUCUGUGC | 1067 | ACACAGUGCUUCAUCCACUACU |
| hsa-miR-3682 | 1068 | CUACUUCUACCUGUGUUAUCAU | 1069 | UGAUGAUACAGGUGGAGGUAG |
| hsa-miR-3683 | 1070 | UGCGACAUUGGAAGUAGUAUCA | 1071 | AUACUACUUCCAAUGUCGCAUU |
| hsa-miR-3684 | 1072 | UUAGACCUAGUACACGUCCUU | 1073 | GGACGGUACUAGGUCUAAAU |
| hsa-miR-3685 | 1074 | UUUCCUACCCUACCUGAAGACU | 1075 | UCUUCAGGUAGGGUAGGAAAUU |
| hsa-miR-3686 | 1076 | AUCUGUAAGAGAAAGUAAAUGA | 1077 | AUUUACUUUCUCUUACAGAUUU |
| hsa-miR-3687 | 1078 | CCCGGACAGGCGUUCGUGCGACGU | 1079 | GUCGCACGAACGCCUGUCCGGGUU |
| hsa-miR-3688 | 1080 | UAUGGAAAGACUUUGCCACUCU | 1081 | AGUGGCAAAGUCUUUCCAUAU |
| hsa-miR-3689a | 1082 | CUGGGAGGUGUGAUAUCGUGGU | 1083 | UGUGAUAUCAUGGUUCCUGGGA |
| hsa-miR-3689b | 1084 | CUGGGAGGUGUGAUAUUGUGGU | 1085 | UGUGAUAUCAUGGUUCCUGGGA |
| hsa-miR-3689c | 1086 | CUGGGAGGUGUGAUAUUGUGGU | 1087 | CACAAUAUCACACCUCCCAGUU |
| hsa-miR-3689d | 1088 | GGGAGGUGUGAUCUCACACUCG | 1089 | AGUGUGAGAUCACACCUCCCUU |
| hsa-miR-3689e | 1090 | UGUGAUAUCAUGGUUCCUGGGA | 1091 | CCAGGAACCAUGAUAUCACAUU |
| hsa-miR-3689f | 1092 | UGUGAUAUCGUGCUUCCUGGGA | 1093 | CCAGGAAGCACGAUAUCACAUU |
| hsa-miR-369 | 1094 | AAUAAUACAUGGUUGAUCUUU | 1095 | AGAUCGACCGUGUUAUAUUCGC |
| hsa-miR-3690 | 1096 | ACCUGGACCCAGCGUAGACAAAG | 1097 | UUGUCUACGCUGGGUCCAGGUUU |
| hsa-miR-3691 | 1098 | AGUGGAUGAUGGAGACUCGGUAC | 1099 | ACCAAGUCGCGUCAUCCUCUC |
| hsa-miR-3692 | 1100 | GUUCCACACUGACACUGCAGAAGU | 1101 | CCUGCUGGUCAGGAGUGGAUACUG |
| hsa-miR-370 | 1102 | GCCUGCUGGGGUGGAACCUGGU | 1103 | CAGGUCACGUCUCUGCAGUUAC |
| hsa-miR-3713 | 1104 | GGUAUCCGUUUGGGGAUGGU | 1105 | CAUCCCAAACGGAUACCUU |
| hsa-miR-3714 | 1106 | GAAGGCAGCAGUGCUCCCCUGU | 1107 | AGGGGAGCAGCUGCCUUCCUU |
| hsa-miR-371a | 1108 | ACUCAAACUGUGGGGGCACU | 1109 | AAGUGCCGCCAUCUUUUGAGUGU |
| hsa-miR-371b | 1110 | ACUCAAAAGAUGGCGGCACUUU | 1111 | AAGUGCCCCCACAGUUUGAGUGC |
| hsa-miR-372 | 1112 | CCUCAAAUGUGGAGCACUAUUCU | 1113 | AAAGUGCUGCGACAUUUGAGCGU |
| hsa-miR-373 | 1114 | GAAGUGCUUCGAUUUUGGGGUGU | 1115 | ACUCAAAAUGGGGGCGCUUUCC |
| hsa-miR-374a | 1116 | UUAUAAUACAACCUGAUAAGUG | 1117 | CUUAUCAGAUUGUAUUGUAAUU |
| hsa-miR-374b | 1118 | CUUAGCAGGUUGUAUUAUCAUU | 1119 | AUAUAAUACAACCUGCUAAGUG |
| hsa-miR-374c | 1120 | CACUUAGCAGGUUGUAUUAUAU | 1121 | AUAAUACAACCUGCUAAGUGCU |
| hsa-miR-375 | 1122 | UUUGUUCGUUCGGCUCGCGUGA | 1123 | ACGCGAGCCGAACGAACAAAUU |
| hsa-miR-376a-1 | 1124 | AUCAUAGAGGAAAAUCCACGU | 1125 | GUAGAUUCUCCUUCUAUGAGUA |
| hsa-miR-376a-2 | 1126 | AUCAUAGAGGAAAAUCCACGU | 1127 | GGUAGAUUUUCCUUCUAUGGU |
| hsa-miR-376b | 1128 | CGUGGAUAUUCCUUCUAUGUUU | 1129 | AUCAUAGAGGAAAAUCCAUGUU |
| hsa-miR-376c | 1130 | GGUGGAUAUUCCUUCUAUGUU | 1131 | AACAUAGAGGAAAUUCCACGU |
| hsa-miR-377 | 1132 | AGAGGUUGCCCUUGGUGAAUUC | 1133 | AUCACACAAAGGCAACUUUUGU |
| hsa-miR-378a | 1134 | CUCCUGACUCCAGGUCCUGUGU | 1135 | ACUGGACUUGGAGUCAGAAGGC |
| hsa-miR-378b | 1136 | ACUGGACUUGGAGGCAGAA | 1137 | CUGCCUCCAAGUCCAGUUU |
| hsa-miR-378c | 1138 | ACUGGACUUGGAGUCAGAAGAGUGG | 1139 | ACUCUUCUGACUCCAAGUCCAGUUU |
| hsa-miR-378d | 1140 | ACUGGACUUGGAGUCAGAAA | 1141 | UCUGACUCCAAGUCCAGUUU |
| hsa-miR-378e | 1142 | ACUGGACUUGGAGUCAGGA | 1143 | CUGACUCCAAGUCCAGUUU |
| hsa-miR-378f | 1144 | ACUGGACUUGGAGCCAGAAG | 1145 | UCUGGCUCCAAGUCCAGUUU |
| hsa-miR-378g | 1146 | ACUGGGCUUGGAGUCAGAAG | 1147 | UCUGACUCCAAGCCCAGUUU |
| hsa-miR-378h | 1148 | ACUGGACUAGUGGUCAGAUGG | 1149 | AUCUGACACCAAGUCCAGUUU |
| hsa-miR-378i | 1150 | ACUGGACUAGGAGUCAGAAGG | 1151 | UUCUGACUCCUAGUCCAGUUU |
| hsa-miR-378j | 1152 | ACUGGAUUUGGAGCCAGAA | 1153 | CUGGCUCCAAAUCCAGUUU |
| hsa-miR-379 | 1154 | UGGUAGACUAUGGAACGUAGG | 1155 | UAUGUAACAUGGUCCACUAACU |
| hsa-miR-380 | 1156 | UGGUUGACCAUAGAACAUGCGC | 1157 | UAUGUAAUAUGGUCCACAUCUU |
| hsa-miR-381 | 1158 | AGCGAGGUUGCCCUUUGUAUAU | 1159 | UAUACAAGGGCAAGCUCUCUGU |

TABLE 1-continued miRNA Sequences

| miRNA | SEQ ID NO | Sequence 1 | SEQ ID NO | Sequence 2 |
|---|---|---|---|---|
| hsa-miR-382 | 1160 | AAUCAUUCACGGACAACACUU | 1161 | GAAGUUGUUCGUGGUGGAUUCG |
| hsa-miR-383 | 1162 | ACAGCACUGCCUGGUCAGA | 1163 | AGAUCAGAAGGUGAUUGUGGCU |
| hsa-miR-384 | 1164 | AUUCCUAGAAAUUGUUCAUA | 1165 | UGAACAAUUUCUAGGAAUUU |
| hsa-miR-3907 | 1166 | AGGUGCUCCAGGCUGGCUCACA | 1167 | UGAGCCAGCCUGGAGCACCUUU |
| hsa-miR-3908 | 1168 | GAGCAAUGUAGGUAGACUGUUU | 1169 | ACAGUCUACCUACAUUGCUCUU |
| hsa-miR-3909 | 1170 | UGUCCUCUAGGGCCUGCAGUCU | 1171 | ACUGCAGGCCCUAGAGGACAUU |
| hsa-miR-3910 | 1172 | AAAGGCAUAAAACCAAGACA | 1173 | UCUUGGUUUUAUGCCUUUUU |
| hsa-miR-3911 | 1174 | UGUGUGGAUCCUGGAGGAGGCA | 1175 | CCUCCUCCAGGAUCCACACAUU |
| hsa-miR-3912 | 1176 | UAACGCAUAAUAUGGACAUGU | 1177 | AUGUCCAUAUUAUGGGUUAGU |
| hsa-miR-3913 | 1178 | UUUGGGACUGAUCUUGAUGUCU | 1179 | AGACAUCAAGAUCAGUCCCAAA |
| hsa-miR-3914 | 1180 | AAGGAACCAGAAAAUGAGAAGU | 1181 | UUCUCAUUUUCUGGUUCCUUUU |
| hsa-miR-3915 | 1182 | UUGAGGAAAAGAUGGUCUUAUU | 1183 | UAAGACCAUCUUUUCCUCAAUU |
| hsa-miR-3916 | 1184 | AAGAGGAAGAAAUGGCUGGUUCUCAG | 1185 | GAGAACCAGCCAUUUCUUCCUCUUUU |
| hsa-miR-3917 | 1186 | GCUCGGACUGAGCAGGUGGG | 1187 | CACCUGCUCAGUCCGAGCUU |
| hsa-miR-3918 | 1188 | ACAGGGCCGCAGAUGGAGACU | 1189 | UCUCCAUCUGCGGCCCUGUUU |
| hsa-miR-3919 | 1190 | GCAGAGAACAAAGGACUCAGU | 1191 | UGAGUCCUUUGUUCUCUGCUU |
| hsa-miR-3920 | 1192 | ACUGAUUAUCUUAACUCUCUGA | 1193 | AGAGAGUUAAGAUAAUCAGUUU |
| hsa-miR-3921 | 1194 | UCUCUGAGUACCAUAUGCCUUGU | 1195 | AAGGCAUAUGGUACUCAGAGAUU |
| hsa-miR-3922 | 1196 | UCUGGCCUUGACUUGACUCUUU | 1197 | UCAAGGCCAGAGGUCCACAGCA |
| hsa-miR-3923 | 1198 | AACUAGUAAUGUUGGAUUAGGG | 1199 | CUAAUCCAACAUUACUAGAUUU |
| hsa-miR-3924 | 1200 | AUAUGUAUAUGUGACUGCUACU | 1201 | UAGCAGUCACAUAUACAUAUUU |
| hsa-miR-3925 | 1202 | AAGAGAACUGAAAGUGGAGCCU | 1203 | ACUCCAGUUUUAGUUCUCUUG |
| hsa-miR-3926 | 1204 | UGGCCAAAAAGCAGGCAGAGA | 1205 | UCUGCCUGCUUUUUGGCCAUU |
| hsa-miR-3927 | 1206 | CAGGUAGAUAUUUGAUAGGCAU | 1207 | GCCUAUCACAUAUCUGCCUGU |
| hsa-miR-3928 | 1208 | UGAAGCUCUAAGGUUCCGCCUGC | 1209 | GGAGGAACCUUGGAGCUUCGGC |
| hsa-miR-3929 | 1210 | GAGGCUGAUGUGAGUAGACCACU | 1211 | UGGUCUACUCACAUCAGCCUCUU |
| hsa-miR-3934 | 1212 | UCAGGUGUGGAAACUGAGGCAG | 1213 | UGCUCAGGUUGCACAGCUGGGA |
| hsa-miR-3935 | 1214 | UGUAGAUACGAGCACCAGCCAC | 1215 | GGCUGGUGCUCGUAUCUACAUU |
| hsa-miR-3936 | 1216 | UAAGGGUGUAUGGCAGAUGCA | 1217 | CAUCUGCCAUACACCCCUUAUU |
| hsa-miR-3937 | 1218 | ACAGGCGGCUGUAGCAAUGGGGG | 1219 | CCCAUUGCUACAGCCGCCUGUUU |
| hsa-miR-3938 | 1220 | AAUUCCCUUGUAGAUAACCCGG | 1221 | GGGUUAUCUACAAGGGAAUUUU |
| hsa-miR-3939 | 1222 | UACGCGCAGACCACAGGAUGUC | 1223 | CAUCCUGUGGUCUGCGCGUAUU |
| hsa-miR-3940 | 1224 | GUGGGUUGGGGCGGGCUCUG | 1225 | CAGCCCGGAUCCCAGCCCACUU |
| hsa-miR-3941 | 1226 | UUACACACAACUGAGGAUCAUA | 1227 | UGAUCCUCAGUUGUGUGUAAUU |
| hsa-miR-3942 | 1228 | AAGCAAUACUGUUACCUGAAAU | 1229 | UUUCAGAUAACAGUAUUACAU |
| hsa-miR-3943 | 1230 | UAGCCCCAGGCUUCACUUGGCG | 1231 | CCAAGUGAAGCCUGGGGGCUAUU |
| hsa-miR-3944 | 1232 | UUCGGCUGGCCUGCUGCUCCGG | 1233 | UGUGCAGCAGGCCCAACCGAGA |
| hsa-miR-3945 | 1234 | AGGGCAUAGGAGAGGGUUGAUAU | 1235 | AUCAACCCUCUCCUAUGCCCUUU |
| hsa-miR-3960 | 1236 | GGCGGCGGCGGAGGCGGGGG | 1237 | CCCGCCUCCGCCGCCGCCUU |
| hsa-miR-3972 | 1238 | CUGCCAGCCCCGUUCCAGGCA | 1239 | CCCUGGAACGGGGCUGGCAGUU |
| hsa-miR-3973 | 1240 | ACAAAGUACAGCAUUAGCCUUAG | 1241 | AAGGCUAAUGCUGUACUUUGUUU |
| hsa-miR-3974 | 1242 | AAAGGUCAUUGUAAGGUUAAUGC | 1243 | AUUAACCUUACAAUGACCUUUUU |
| hsa-miR-3975 | 1244 | UGAGGCUAAUGCACUACUUCAC | 1245 | GAAGUAGUGCAUUAGCCUCAUU |
| hsa-miR-3976 | 1246 | UAUAGAGAGCAGGAAGAUUAAUGU | 1247 | AUUAAUCUUCCUGCUCUCUAUAUU |
| hsa-miR-3977 | 1248 | GUGCUUCAUCGUAAUUAACCUUA | 1249 | AGGGUAAAUUACGAUGAAGCACAU |
| hsa-miR-3978 | 1250 | GUGGAAAGCAUGCAUCCAGGGUGU | 1251 | ACCCUGGAUGCAUGCUUUCCACUU |
| hsa-miR-409 | 1252 | GAAUGUUGCUCGGUGAACCCCU | 1253 | AGGUUACCCGAGCAACUUUGCAU |
| hsa-miR-410 | 1254 | AGGUUGUCUGUGAUGAGUUCG | 1255 | AAUAUAACACAGAUGGCCUGU |
| hsa-miR-411 | 1256 | UAUGUAACACGGUCCACUAACC | 1257 | UAGUAGACCGUAUAGCGUACG |
| hsa-miR-412 | 1258 | UGGUCGACCAGUUGGAAAGUAAU | 1259 | ACUUCACCUGGUCCACUAGCCGU |
| hsa-miR-421 | 1260 | AUCAACAGACAUUAAUUGGGCGC | 1261 | GCCCAAUUAAUGUCUGUUGAUUU |
| hsa-miR-422a | 1262 | ACUGGACUUAGGGUCAGAAGGC | 1263 | CUUCUGACCCUAAGUCCAGUUU |
| hsa-miR-423 | 1264 | UGAGGGGCAGAGAGCGAGACUUU | 1265 | AGCUCGGUCUGAGGCCCCUCAGU |
| hsa-miR-424 | 1266 | CAGCAGCAAUUCAUGUUUUGAA | 1267 | CAAAACGUGAGGCGCUGCUAU |
| hsa-miR-425 | 1268 | AUCGGGAAUGUCGUGUCCGCCC | 1269 | AAUGACACGAUCACUCCCGUUGA |
| hsa-miR-4251 | 1270 | CCUGAGAAAGGGCCAA | 1271 | GGCCCUUUUCUCAGGUU |
| hsa-miR-4252 | 1272 | GGCCACUGAGUCAGCACCA | 1273 | GUGCUGACUCAGUGGCCUU |
| hsa-miR-4253 | 1274 | AGGGCAUGUCCAGGGGU | 1275 | CCCCUGGACAUGCCCUUU |
| hsa-miR-4254 | 1276 | GCCUGGAGCUACUCCACCAUCUC | 1277 | GAUGGUGGAGUAGCUCCAGGCUU |
| hsa-miR-4255 | 1278 | CAGUGUUCAGAGAUGGA | 1279 | CAUCUCUGAACACUGUU |
| hsa-miR-4256 | 1280 | AUCUGACCUGAUGAAGGU | 1281 | CUUCAUCAGGUCAGAUUU |
| hsa-miR-4257 | 1282 | CCAGAGGUGGGGACUGAG | 1283 | CAGUCCCCACCUCUGGUU |
| hsa-miR-4258 | 1284 | CCCCGCCACCGCCUUGG | 1285 | AAGGCGGUGGCGGGGUU |
| hsa-miR-4259 | 1286 | CAGUUGGGUCUAGGGGUCAGGA | 1287 | CUGACCCCUAGACCCAACUGUU |
| hsa-miR-4260 | 1288 | CUUGGGGCAUGGAGUCCCA | 1289 | GGACUCCAUGCCCCAAGUU |
| hsa-miR-4261 | 1290 | AGGAAACAGGGACCCA | 1291 | GGUCCCUGUUUCCUUU |
| hsa-miR-4262 | 1292 | GACAUUCAGACUACCUG | 1293 | GGUAGUCUGAAUGUCUU |
| hsa-miR-4263 | 1294 | AUUCUAAGUGCCUUGGCC | 1295 | CCAAGGCACUUAGAAUUU |
| hsa-miR-4264 | 1296 | ACUCAGUCAUGGUCAUU | 1297 | UGACCAUGACUGAGUUU |
| hsa-miR-4265 | 1298 | CUGUGGGCUCACUCUCUGGG | 1299 | CAGAGAGUGAGCCCACAGUU |
| hsa-miR-4266 | 1300 | CUAGGAGGCCUUGGCC | 1301 | CCAAGGCCUCCUAGUU |
| hsa-miR-4267 | 1302 | UCCAGCUCGGUGGCAC | 1303 | GCCACCGAGCUGGAUUU |
| hsa-miR-4268 | 1304 | GGCUCCUCCUCUCAGGAUGUG | 1305 | CAUCCUGAGAGGAGGAGCCUU |
| hsa-miR-4269 | 1306 | GCAGGCACAGACAGCCCUGGC | 1307 | CAGGGCUGUCUGUGCCUGCUU |
| hsa-miR-4270 | 1308 | UCAGGGAGUCAGGGGAGGGU | 1309 | CCUCCCCUGACUCCCUGAUUU |

TABLE 1-continued miRNA Sequences

| miRNA | SEQ ID NO | Sequence 1 | SEQ ID NO | Sequence 2 |
|---|---|---|---|---|
| hsa-miR-4271 | 1310 | GGGGGAAGAAAAGGUGGGG | 1311 | CCACCUUUUCUUCCCCCUU |
| hsa-miR-4272 | 1312 | CAUUCAACUAGUGAUUGU | 1313 | AAUCACUAGUUGAAUGUU |
| hsa-miR-4273 | 1314 | GUGUUCUCUGAUGGACAG | 1315 | GUCCAUCAGAGAACACUU |
| hsa-miR-4274 | 1316 | CAGCAGUCCCUCCCCCUG | 1317 | GGGGGAGGGACUGCUGUU |
| hsa-miR-4275 | 1318 | CCAAUUACCACUUCUUU | 1319 | AGAAGUGGUAAUUGGUU |
| hsa-miR-4276 | 1320 | CUCAGUGACUCAUGUGC | 1321 | ACAUGAGUCACUGAGUU |
| hsa-miR-4277 | 1322 | GCAGUUCUGAGCACAGUACAC | 1323 | GUACUGUGCUCAGAACUGCUU |
| hsa-miR-4278 | 1324 | CUAGGGGGUUUGCCCUUG | 1325 | AGGGCAAACCCCCUAGUU |
| hsa-miR-4279 | 1326 | CUCUCCUCCCGGCUUC | 1327 | AGCCGGGAGGAGAGUU |
| hsa-miR-4280 | 1328 | GAGUGUAGUUCUGAGCAGAGC | 1329 | UCUGCUCAGAACUACACUCUU |
| hsa-miR-4281 | 1330 | GGGUCCCGGGGAGGGGG | 1331 | CCCCUCCCCGGGACCCUU |
| hsa-miR-4282 | 1332 | UAAAAUUUGCAUCCAGGA | 1333 | CUGGAUGCAAAUUUUAUU |
| hsa-miR-4283 | 1334 | UGGGGCUCAGCGAGUUU | 1335 | ACUCGCUGAGCCCCAUU |
| hsa-miR-4284 | 1336 | GGGCUCACAUCACCCCAU | 1337 | GGGGUGAUGUGAGCCCUU |
| hsa-miR-4285 | 1338 | GCGGCGAGUCCGACUCAU | 1339 | GAGUCGGACUCGCCGCUU |
| hsa-miR-4286 | 1340 | ACCCCACUCCUGGUACC | 1341 | UACCAGGAGUGGGGUUU |
| hsa-miR-4287 | 1342 | UCUCCCUUGAGGGCACUUU | 1343 | AGUGCCCUCAAGGGAGAUU |
| hsa-miR-4288 | 1344 | UUGUCUGCUGAGUUUCC | 1345 | AAACUCAGCAGACAAUU |
| hsa-miR-4289 | 1346 | GCAUUGUGCAGGGCUAUCA | 1347 | AUAGCCCUGCACAAUGCUU |
| hsa-miR-429 | 1348 | UAAUACUGUCUGGUAAAACCGU | 1349 | GGUUUUACCAGACAGUAUUAUU |
| hsa-miR-4290 | 1350 | UGCCCUCCUUUCUUCCCUC | 1351 | GGGAAGAAAGGAGGGCAUU |
| hsa-miR-4291 | 1352 | UUCAGCAGGAACAGCU | 1353 | CUGUUCCUGCUGAAUU |
| hsa-miR-4292 | 1354 | CCCCUGGGCCGGCCUUGG | 1355 | AAGGCCGGCCCAGGGGUU |
| hsa-miR-4293 | 1356 | CAGCCUGACAGGAACAG | 1357 | GUUCCUGUCAGGCUGUU |
| hsa-miR-4294 | 1358 | GGGAGUCUACAGCAGGG | 1359 | CUGCUGUAGACUCCCUU |
| hsa-miR-4295 | 1360 | CAGUGCAAUGUUUUCCUU | 1361 | GGAAAACAUUGCACUGUU |
| hsa-miR-4296 | 1362 | AUGUGGGCUCAGGCUCA | 1363 | AGCCUGAGCCCACAUUU |
| hsa-miR-4297 | 1364 | UGCCUUCCUGUCUGUG | 1365 | CAGACAGGAAGGCAUU |
| hsa-miR-4298 | 1366 | CUGGACAGGAGGAGGAGGCAG | 1367 | GCCUCCUCCUCCUGUCCAGUU |
| hsa-miR-4299 | 1368 | GCUGGUGACAUGAGAGGC | 1369 | CUCUCAUGUCACCAGCUU |
| hsa-miR-4300 | 1370 | UGGGAGCUGGACUACUUC | 1371 | AGUAGUCCAGCUCCCAUU |
| hsa-miR-4301 | 1372 | UCCCACUACUUCACUUGUGA | 1373 | ACAAGUGAAGUAGUGGGAUU |
| hsa-miR-4302 | 1374 | CCAGUGUGGCUCAGCGAG | 1375 | CGCUGAGCCACACUGGUU |
| hsa-miR-4303 | 1376 | UUCUGAGCUGAGGACAG | 1377 | GUCCUCAGCUCAGAAUU |
| hsa-miR-4304 | 1378 | CCGGCAUGUCCAGGGCA | 1379 | CCCUGGACAUGCCGGUU |
| hsa-miR-4305 | 1380 | CCUAGACACCUCCAGUUC | 1381 | ACUGGAGGUGUCUAGGUU |
| hsa-miR-4306 | 1382 | UGGAGAGAAAGGCAGUA | 1383 | CUGCCUUUCUCUCCAUU |
| hsa-miR-4307 | 1384 | AAUGUUUUUCCUGUUCC | 1385 | AAACAGGAAAAACAUUUU |
| hsa-miR-4308 | 1386 | UCCCUGGAGUUUCUUCUU | 1387 | GAAGAAACUCCAGGGAUU |
| hsa-miR-4309 | 1388 | CUGGAGUCUAGGAUUCCA | 1389 | GAAUCCUAGACUCCAGUU |
| hsa-miR-431 | 1390 | UGUCUUGCAGGCCGUCAUGCA | 1391 | CAGGUCGUCUUGCAGGGCUUCU |
| hsa-miR-4310 | 1392 | GCAGCAUUCAUGUCCC | 1393 | GACAUGAAUGCUGCUU |
| hsa-miR-4311 | 1394 | GAAAGAGAGCUGAGUGUG | 1395 | CACUCAGCUCUCUUUCUU |
| hsa-miR-4312 | 1396 | GGCCUUGUUCCUGUCCCCA | 1397 | GGGACAGGAACAAGGCCUU |
| hsa-miR-4313 | 1398 | AGCCCCCUGGCCCCAAACCC | 1399 | GUUUGGGGCCAGGGGGCUUU |
| hsa-miR-4314 | 1400 | CUCUGGGAAAUGGGACAG | 1401 | GUCCCAUUUCCCAGAGUU |
| hsa-miR-4315 | 1402 | CCGCUUUCUGAGCUGGAC | 1403 | CCAGCUCAGAAAGCGGUU |
| hsa-miR-4316 | 1404 | GGUGAGGCUAGCUGGUG | 1405 | CCAGCUAGCCUCACCUU |
| hsa-miR-4317 | 1406 | ACAUUGCCAGGGAGUUU | 1407 | ACUCCCUGGCAAUGUUU |
| hsa-miR-4318 | 1408 | CACUGUGGGUACAUGCU | 1409 | CAUGUACCCACAGUGUU |
| hsa-miR-4319 | 1410 | UCCCUGAGCAAAGCCAC | 1411 | GGCUUUGCUCAGGGAUU |
| hsa-miR-432 | 1412 | UCUUGGAGUAGGUCAUUGGGUGG | 1413 | CUGGAUGGCUCCUCCAUGUCU |
| hsa-miR-4320 | 1414 | GGGAUUCUGUAGCUUCCU | 1415 | GAAGCUACAGAAUCCCUU |
| hsa-miR-4321 | 1416 | UUAGCGGUGGACCGCCCUGCG | 1417 | CAGGGCGGUCCACCGCUAAUU |
| hsa-miR-4322 | 1418 | CUGUGGGCUCAGCGCGUGGGG | 1419 | CCACGCGCUGAGCCCACAGUU |
| hsa-miR-4323 | 1420 | CAGCCCCACAGCCUCAGA | 1421 | UGAGGCUGUGGGGCUGUU |
| hsa-miR-4324 | 1422 | CCCUGAGACCCUAACCUUAA | 1423 | AAGGUUAGGGUCUCAGGGUU |
| hsa-miR-4325 | 1424 | UUGCACUUGUCUCAGUGA | 1425 | ACUGAGACAAGUGCAAUU |
| hsa-miR-4326 | 1426 | UGUUCCUCUGUCUCCCAGAC | 1427 | CUGGGAGACAGAGGAACAUU |
| hsa-miR-4327 | 1428 | GGCUUGCAUGGGGGACUGG | 1429 | AGUCCCCCAUGCAAGCCUU |
| hsa-miR-4328 | 1430 | CCAGUUUUCCCAGGAUU | 1431 | UCCUGGGAAAACUGGUU |
| hsa-miR-4329 | 1432 | CCUGAGACCCUAGUUCCAC | 1433 | GGAACUAGGGUCUCAGGUU |
| hsa-miR-433 | 1434 | UACGGUGAGCCUGUCAUUAUUC | 1435 | AUCAUGAUGGGCUCCUCGGUGU |
| hsa-miR-4330 | 1436 | CCUCAGAUCAGAGCCUUGC | 1437 | AAGGCUCUGAUCUGAGGUU |
| hsa-miR-4417 | 1438 | GGUGGGCUUCCCGGAGGG | 1439 | CUCCGGGAAGCCCACCUU |
| hsa-miR-4418 | 1440 | CACUGCAGGACUCAGCAG | 1441 | CUGCUGAGUCCUGCAGUGUU |
| hsa-miR-4419a | 1442 | UGAGGGAGGAGACUGCA | 1443 | CAGUCUCCUCCCUCAUU |
| hsa-miR-4419b | 1444 | GAGGCUGAAGGAAGAUGG | 1445 | AUCUUCCUUCAGCCUCUU |
| hsa-miR-4420 | 1446 | GUCACUGAUGUCUGUAGCUGAG | 1447 | CAGCUACAGACAUCAGUGACUU |
| hsa-miR-4421 | 1448 | ACCUGUCUGUGGAAAGGAGCUA | 1449 | GCUCCUUUCCACAGACAGGUUU |
| hsa-miR-4422 | 1450 | AAAAGCAUCAGGAAGUACCCA | 1451 | GGUACUUCCUGAUGCUUUUUU |
| hsa-miR-4423 | 1452 | AGUUGCCUUUUGUUCCCAUGC | 1453 | AUAGGCACCAAAAAGCAACAA |
| hsa-miR-4424 | 1454 | AGAGUUAACUCAAAAUGGACUA | 1455 | GUCCAUUUGAGUUAACUCUUU |
| hsa-miR-4425 | 1456 | UGUUGGGAUUCAGCAGGACCAU | 1457 | GGUCCUGCUGAAUCCCAACAUU |
| hsa-miR-4426 | 1458 | GAAGAUGGACGUACUUU | 1459 | AGUACGUCCAUCUUCUU |

TABLE 1-continued miRNA Sequences

| miRNA | SEQ ID NO | Sequence 1 | SEQ ID NO | Sequence 2 |
|---|---|---|---|---|
| hsa-miR-4427 | 1460 | UCUGAAUAGAGUCUGAAGAGU | 1461 | UCUUCAGACUCUAUUCAGAUU |
| hsa-miR-4428 | 1462 | CAAGGAGACGGGAACAUGGAGC | 1463 | UCCAUGUUCCCGUCUCCUUGUU |
| hsa-miR-4429 | 1464 | AAAAGCUGGGCUGAGAGGCG | 1465 | CCUCUCAGCCCAGCUUUUUU |
| hsa-miR-4430 | 1466 | AGGCUGGAGUGAGCGGAG | 1467 | CCGCUCACUCCAGCCUUU |
| hsa-miR-4431 | 1468 | GCGACUCUGAAAACUAGAAGGU | 1469 | CUUCUAGUUUUCAGAGUCGCUU |
| hsa-miR-4432 | 1470 | AAAGACUCUGCAAGAUGCCU | 1471 | GCAUCUUGCAGAGUCUUUUU |
| hsa-miR-4433a | 1472 | ACAGGAGUGGGGGUGGGACAU | 1473 | CGUCCCACCCCCACUCCUGU |
| hsa-miR-4433b | 1474 | CAGGAGUGGGGGUGGGACGU | 1475 | AGUCCCACCCCCACUCCUGU |
| hsa-miR-4434 | 1476 | AGGAGAAGUAAAGUAGAA | 1477 | CUACUUUACUUCUCCUUU |
| hsa-miR-4435 | 1478 | AUGGCCAGAGCUCACACAGAGG | 1479 | UCUGUGUGAGCUCUGGCCAUUU |
| hsa-miR-4436a | 1480 | GCAGGACAGGCAGAAGUGGAU | 1481 | CCACUUCUGCCUGUCCUGCUU |
| hsa-miR-4436b | 1482 | GUCCACUUCUGCCUGCCCUGCC | 1483 | CAGGGCAGGAAGAAGUGGACAA |
| hsa-miR-4437 | 1484 | UGGGCUCAGGGUACAAAGGUU | 1485 | CCUUUGUACCCUGAGCCCAUU |
| hsa-miR-4438 | 1486 | CACAGGCUUAGAAAAGACAGU | 1487 | UGUCUUUUCUAAGCCUGUGUU |
| hsa-miR-4439 | 1488 | GUGACUGAUACCUUGGAGGCAU | 1489 | GCCUCCAAGGUAUCAGUCACUU |
| hsa-miR-4440 | 1490 | UGUCGUGGGGCUUGCUGGCUUG | 1491 | AGCCAGCAAGCCCCACGACAUU |
| hsa-miR-4441 | 1492 | ACAGGGAGGAGAUUGUA | 1493 | CAAUCUCCUCCCUGUUU |
| hsa-miR-4442 | 1494 | GCCGGACAAGAGGGAGG | 1495 | UCCCUCUUGUCCGGCUU |
| hsa-miR-4443 | 1496 | UUGGAGGCGUGGGUUUU | 1497 | AACCCACGCCUCCAAUU |
| hsa-miR-4444 | 1498 | CUCGAGUUGGAAGAGGCG | 1499 | CCUCUUCCAACUCGAGUU |
| hsa-miR-4445 | 1500 | AGAUUGUUUCUUUUGCCGUGCA | 1501 | CACGGCAAAAGAAACAAUCCA |
| hsa-miR-4446 | 1502 | AUUUCCCUGCCAUUCCCUUGGC | 1503 | CAGGGCUGGCAGUGACAUGGGU |
| hsa-miR-4447 | 1504 | GGUGGGGGCUGUUGUUUU | 1505 | ACAACAGCCCCCACCUU |
| hsa-miR-4448 | 1506 | GGCUCCUUGGUCUAGGGGUA | 1507 | CCCCUAGACCAAGGAGCCUU |
| hsa-miR-4449 | 1508 | CGUCCCGGGGCUGCGCGAGGCA | 1509 | CCUGCGCAGCCCCGGGACGUU |
| hsa-miR-4450 | 1510 | UGGGGAUUUGGAGAAGUGGUGA | 1511 | ACCACUUCUCCAAAUCCCCAUU |
| hsa-miR-4451 | 1512 | UGGUAGAGCUGAGGACA | 1513 | UCCUCAGCUCUACCAUU |
| hsa-miR-4452 | 1514 | UUGAAUUCUUGGCCUUAAGUGAU | 1515 | CACUUAAGGCCAAGAAUUCAAUU |
| hsa-miR-4453 | 1516 | GAGCUUGGUCUGUAGCGGUU | 1517 | CCGCUACAGACCAAGCUCUU |
| hsa-miR-4454 | 1518 | GGAUCCGAGUCACGGCACCA | 1519 | GUGCCGUGACUCGGAUCCUU |
| hsa-miR-4455 | 1520 | AGGGUGUGUGUGUUUUU | 1521 | AAACACACACACCCUUU |
| hsa-miR-4456 | 1522 | CCUGGUGGCUUCCUUUU | 1523 | AAGGAAGCCACCAGGUU |
| hsa-miR-4457 | 1524 | UCACAAGGUAUUGACUGGCGUA | 1525 | CGCCAGUCAAUACCUUGUGAUU |
| hsa-miR-4458 | 1526 | AGAGGUAGGUGUGGAAGAA | 1527 | CUUCCACACCUACCUCUUU |
| hsa-miR-4459 | 1528 | CCAGGAGGCGGAGGAGGUGGAG | 1529 | CCACCUCCUCCGCCUCCUGGUU |
| hsa-miR-4460 | 1530 | AUAGUGGUUGUGAAUUUACCUU | 1531 | GGUAAAUUCACAACCACUAUUU |
| hsa-miR-4461 | 1532 | GAUUGGACUAGUAGGGCUAGGC | 1533 | CUAGCCCUACUAGUCCAAUCUU |
| hsa-miR-4462 | 1534 | UGACACGGAGGUGGCUUGGGAA | 1535 | CCCAAGCCACCUCCGUGUCAUU |
| hsa-miR-4463 | 1536 | GAGACUGGGGUGGGCC | 1537 | CCCCACCCCAGUCUCUU |
| hsa-miR-4464 | 1538 | AAGGUUUGGAUAGAUGCAAUA | 1539 | UUGCAUCUAUCCAAACCUUUU |
| hsa-miR-4465 | 1540 | CUCAAGUAGUCUGACCAGGGGA | 1541 | CCCUGGUCAGACUACUUGAGUU |
| hsa-miR-4466 | 1542 | GGGUGCGGGCCGGCGGGG | 1543 | CCGCCGGCCCGCACCCUU |
| hsa-miR-4467 | 1544 | UGGCGGCGGUAGUUAUGGGCUU | 1545 | GCCCAUAACUACCGCCGCCAUU |
| hsa-miR-4468 | 1546 | AGAGCAGAAGGAUGAGAU | 1547 | CUCAUCCUUCUGCUCUUU |
| hsa-miR-4469 | 1548 | GCUCCCUCUAGGGUCGCUCGGA | 1549 | CGAGCGACCCUAGAGGGAGCUU |
| hsa-miR-4470 | 1550 | UGGCAAACGUGGAAGCCGAGA | 1551 | UCGGCUUCCACGUUUGCCAUU |
| hsa-miR-4471 | 1552 | UGGGAACUUAGUAGAGGUUUAA | 1553 | AAACCUCUACUAAGUUCCCAUU |
| hsa-miR-4472 | 1554 | GGUGGGGGUGUUGUUUU | 1555 | AACAACACCCCCACCUU |
| hsa-miR-4473 | 1556 | CUAGUGCUCUCCGUUACAAGUA | 1557 | CUUGUAACGGAGAGCACUAGUU |
| hsa-miR-4474 | 1558 | UUGUGGCUGGUCAUGAGGCUAA | 1559 | UUAGUCUCAUGAUCAGACACA |
| hsa-miR-4475 | 1560 | CAAGGGACCAAGCAUUCAUUAU | 1561 | AAUGAAUGCUUGGUCCCUUGUU |
| hsa-miR-4476 | 1562 | CAGGAAGGAUUUAGGGACAGGC | 1563 | CUGUCCCUAAAUCCUUCCUGUU |
| hsa-miR-4477a | 1564 | CUAUUAAGGACAUUUGUGAUUC | 1565 | AUCACAAAUGUCCUUAAUAGUU |
| hsa-miR-4477b | 1566 | AUUAAGGACAUUUGUGAUUGAU | 1567 | CAAUCACAAAUGUCCUUAAUUUU |
| hsa-miR-4478 | 1568 | GAGGCUGAGCUGAGGAG | 1569 | CCUCAGCUCAGCCUCUU |
| hsa-miR-4479 | 1570 | CGCGCGCCGUGCUCGGAGCAG | 1571 | GCUCCGAGCACGGCCGCGCGUU |
| hsa-miR-448 | 1572 | UUGCAUAUGUAGGAUGUCCCAU | 1573 | GGGACAUCCUACAUAUGCAAUU |
| hsa-miR-4480 | 1574 | AGCCAAGUGGAAGUUACUUUA | 1575 | AAGUAACUUCCACUUGGCUUU |
| hsa-miR-4481 | 1576 | GGAGUGGGCUGGUGGUU | 1577 | CCACCAGCCCACUCCUU |
| hsa-miR-4482 | 1578 | UUUCUAUUUCUCAGUGGGGCUC | 1579 | AACCCAGUGGGCUAUGGAAAUG |
| hsa-miR-4483 | 1580 | GGGGUGGUCUGUUGUUG | 1581 | ACAACAGACCACCCCUU |
| hsa-miR-4484 | 1582 | AAAAGGCGGGAGAAGCCCCA | 1583 | GGGCUUCUCCCGCCUUUUUU |
| hsa-miR-4485 | 1584 | UAACGGCCGCGGUACCCUAA | 1585 | ACCGCCUGCCCAGUGA |
| hsa-miR-4486 | 1586 | GCUGGGCGAGGCUGGCA | 1587 | CCAGCCUCGCCCAGCUU |
| hsa-miR-4487 | 1588 | AGAGCUGGCUGAAGGGCAG | 1589 | GCCCUUCAGCCAGCUCUUU |
| hsa-miR-4488 | 1590 | AGGGGGCGGGCUCCGGCG | 1591 | CCGGAGCCCGCCCCCUUU |
| hsa-miR-4489 | 1592 | UGGGGCUAGUGAUGCAGGACG | 1583 | UCCUGCAUCACUAGCCCCAUU |
| hsa-miR-4490 | 1594 | UCUGGUAAGAGAUUUGGGCAUA | 1595 | UGCCCAAAUCUCUUACCAGAUU |
| hsa-miR-4491 | 1596 | AAUGUGGACUGGUGUGACCAAA | 1597 | UGGUCACACCAGUCCACAUUUU |
| hsa-miR-4492 | 1598 | GGGGCUGGGCGCGCGCC | 1599 | CGCGCGCCCAGCCCCUU |
| hsa-miR-4493 | 1600 | AGAAGGCCUUUCCAUCUCUGU | 1601 | AGAGAUGGAAAGGCCUUCUUU |
| hsa-miR-4494 | 1602 | CCAGACUGUGGCUGACCAGAGG | 1603 | UCUGGUCAGCCACAGUCUGGUU |
| hsa-miR-4495 | 1604 | AAUGUAAACAGGCUUUUUGCU | 1605 | CAAAAAGCCUGUUUACAUUUU |
| hsa-miR-4496 | 1606 | GAGGAAACUGAAGCUGAGAGGG | 1607 | CUCUCAGCUUCAGUUUCCUCUU |
| hsa-miR-4497 | 1608 | CUCCGGGACGGCUGGGC | 1609 | CCAGCCGUCCCGGAGUU |

TABLE 1-continued miRNA Sequences

| miRNA | SEQ ID NO | Sequence 1 | SEQ ID NO | Sequence 2 |
| --- | --- | --- | --- | --- |
| hsa-miR-4498 | 1610 | UGGGCUGGCAGGGCAAGUGCUG | 1611 | GCACUUGCCCUGCCAGCCCAUU |
| hsa-miR-4499 | 1612 | AAGACUGAGAGGAGGGA | 1613 | CCUCCUCUCAGUCUUUU |
| hsa-miR-449a | 1614 | UGGCAGUGUAUUGUUAGCUGGU | 1615 | CAGCUAACAAUACACUGCCAUU |
| hsa-miR-449b | 1616 | CAGCCACAACUACCCUGCCACU | 1617 | AGGCAGUGUAUUGUUAGCUGGC |
| hsa-miR-449c | 1618 | UAGGCAGUGUAUUGCUAGCGGCUGU | 1619 | UUGCUAGUUGCACUCCUCUCUGU |
| hsa-miR-4500 | 1620 | UGAGGUAGUAGUUUCUU | 1521 | GAAACUACUACCUCAUU |
| hsa-miR-4501 | 1622 | UAUGUGACCUCGGAUGAAUCA | 1623 | AUUCAUCCGAGGUCACAUAUU |
| hsa-miR-4502 | 1624 | GCUGAUGAUGAUGGUGCUGAAG | 1625 | UCAGCACCAUCAUCAUCAGCUU |
| hsa-miR-4503 | 1626 | UUUAAGCAGGAAAUAGAAUUUA | 1627 | AAUUCUAUUUCCUGCUUAAAUU |
| hsa-miR-4504 | 1628 | UGUGACAAUAGAGAUGAACAUG | 1629 | UGUUCAUCUCUAUUGUCACAUU |
| hsa-miR-4505 | 1630 | AGGCUGGGCUGGGACGGA | 1631 | CGUCCCAGCCCAGCCCUUU |
| hsa-miR-4506 | 1632 | AAAUGGGUGGUCUGAGGCAA | 1633 | GCCUCAGACCACCCAUUUUU |
| hsa-miR-4507 | 1634 | CUGGGUUGGGCUGGGCUGGG | 1635 | CAGCCCAGCCCAACCCAGUU |
| hsa-miR-4508 | 1636 | GCGGGGCUGGGCGCGCG | 1637 | CGCGCCCAGCCCCGCUU |
| hsa-miR-4509 | 1638 | ACUAAAGGAUAUAGAAGGUUUU | 1639 | AACCUUCUAUAUCCUUUAGUUU |
| hsa-miR-450a-1 | 1640 | UUUUGCGAUGUGUUCCUAAUAU | 1641 | AUUGGGAACAUUUUGCAUGUAU |
| hsa-miR-450a-2 | 1642 | UUUUGCGAUGUGUUCCUAAUAU | 1643 | AUUGGGACAUUUUGCAUUCAU |
| hsa-miR-450b | 1644 | UUUUGCAAUAUGUUCCUGAAUA | 1645 | UUGGGAUCAUUUUGCAUCCAUA |
| hsa-miR-4510 | 1646 | UGAGGGAGUAGGAUGUAUGGUU | 1647 | CCAUACAUCCUACUCCCUCAUU |
| hsa-miR-4511 | 1648 | GAAGAACUGUUGCAUUUGCCCU | 1649 | GGCAAAUGCAACAGUUCUUCUU |
| hsa-miR-4512 | 1650 | CAGGGCCUCACUGUAUCGCCCA | 1651 | GGCGAUACAGUGAGGCCCUGUU |
| hsa-miR-4513 | 1652 | AGACUGACGGCUGGAGGCCCAU | 1653 | GGGCCUCCAGCCGUCAGUCUUU |
| hsa-miR-4514 | 1654 | ACAGGCAGGAUUGGGGAA | 1655 | CCCCAAUCCUGCCUGUUU |
| hsa-miR-4515 | 1656 | AGGACUGGACUCCCGGCAGCCC | 1657 | GCUGCCGGGAGUCCAGCCCUUU |
| hsa-miR-4516 | 1658 | GGGAGAAGGGUCGGGGC | 1659 | CCCGACCCUUCUCCCUU |
| hsa-miR-4517 | 1660 | AAAUAUGAUGAAACUCACAGCUGAG | 1661 | CAGCUGUGAGUUUCAUCAUAUUUUU |
| hsa-miR-4518 | 1662 | GCUCAGGAUGAUAACUGUGCUGAGA | 1663 | UCAGCACAGUUAUCAUCCCUGAGCUU |
| hsa-miR-4519 | 1664 | CAGCAGUGCGCAGGGCUG | 1665 | GCCCUGCGCACUGCUGUU |
| hsa-miR-451a | 1666 | AAACCGUUACCAUUACUGAGUU | 1667 | CUCAGUAAUGGUAACGGUUUUU |
| hsa-miR-451b | 1668 | UAGCAAGAGAACCAUUACCAUU | 1669 | UGGUAAUGGUUCUCUUGCUAUU |
| hsa-miR-452 | 1670 | AACUGUUUGCAGAGGAAACUGA | 1671 | CUCAUCUGCAAAGAAGUAAGUG |
| hsa-miR-4520-1 | 1672 | CCUGCGUGUUUUCUGUCCAA | 1673 | UUGGACAGAAAACACGCAGGAA |
| hsa-miR-4520-2 | 1674 | CCUGCGUGUUUUCUGUCCAA | 1675 | UUUGGACAGAAAACACGCAGGU |
| hsa-miR-4521 | 1676 | GCUAAGGAAGUCCUGUGCUCAG | 1677 | GAGCACAGGACUUCCUUAGCUU |
| hsa-miR-4522 | 1678 | UGACUCUGCCUGUAGGCCGGU | 1679 | CGGCCUACAGGCAGAGUCAUU |
| hsa-miR-4523 | 1680 | GACCGAGAGGGCUCGGCUGU | 1681 | AGCCGAGGCCCUCUCGGUCUU |
| hsa-miR-4524a | 1682 | AUAGCAGCAUGAACCUGUCUCA | 1683 | UGAGACAGGUUCAUGCUGCUAU |
| hsa-miR-4524b | 1684 | AUAGCAGCAUAAGCCUGUCUC | 1685 | GAGACAGGUUCAUGCUGCUA |
| hsa-miR-4525 | 1686 | GGGGGGAUGUGCAUGCUGGUU | 1687 | CCAGCAUGCACAUCCCCCCUU |
| hsa-miR-4526 | 1688 | GCUGACAGCAGGGCUGGCCGCU | 1689 | CGGCCAGCCCUGCUGUCAGCUU |
| hsa-miR-4527 | 1690 | UGGUCUGCAAAGAGAUGCUGU | 1691 | AGUCAUCUCUUUGCAGACCAUU |
| hsa-miR-4528 | 1692 | UCAUUAUGUAUGAUCUGGAC | 1693 | CCAGAUCAUACAUAUAAUGAUU |
| hsa-miR-4529 | 1694 | AGGCCAUCAGCAGUCCAAUGAA | 1695 | AUUGGACUGCUGAUGGCCCGU |
| hsa-miR-4530 | 1696 | CCCAGCAGGACGGGAGCG | 1697 | CUCCCGUCCUGCUGGGUU |
| hsa-miR-4531 | 1698 | AUGGAGAAGGCUUCUGA | 1699 | AGAAGCUUCUCCAUUU |
| hsa-miR-4532 | 1700 | CCCCGGGGAGCCCGGCG | 1701 | CCGGGCUCCCCGGGGUU |
| hsa-miR-4533 | 1702 | UGGAAGGAGGUUGCCGGACGCU | 1703 | CGUCCGGCAACCUCCUUCCAUU |
| hsa-miR-4534 | 1704 | GGAUGGAGGAGGGGUCU | 1705 | ACCCCUCCUCCAUCCUU |
| hsa-miR-4535 | 1706 | GUGGACCUGGCUGGGAC | 1707 | CCCAGCCAGGUCCACUU |
| hsa-miR-4536 | 1708 | UCGUGCAUAUAUCUACCACAU | 1709 | UGUGGUAGAUAUAUGCACGAU |
| hsa-miR-4537 | 1710 | UGAGCCGAGCUGAGCUUAGCUG | 1711 | GCUAAGCUCAGCUCGGCUCAUU |
| hsa-miR-4538 | 1712 | GAGCUUGGAUGAGCUGGGCUGA | 1713 | AGCCCAGCUCAUCCAAGCUCUU |
| hsa-miR-4539 | 1714 | GCUGAACUGGGCUGAGCUGGGC | 1715 | CCAGCUCAGCCCAGUUCAGCUU |
| hsa-miR-454 | 1716 | ACCCUAUCAAUAUUGUCUCUGC | 1717 | UAGUGCAAUAUUGCUUAUAGGGU |
| hsa-miR-4540 | 1718 | UUAGUCCUGCCUGUAGGUUUA | 1719 | AACCUACAGGCAGGACUAAUU |
| hsa-miR-455 | 1720 | GCAGUCCAUGGGCAUAUACAC | 1721 | UAUGUGCCUUUGGACUACAUCG |
| hsa-miR-4632 | 1722 | UGCCGCCCUCUCGCUGCUCUAG | 1723 | GAGGGCAGCGUGGGUGUGGCGGA |
| hsa-miR-4633 | 1724 | AUAUGCCUGGCUAGCUCCUC | 1725 | AGGAGCUAGCCAGGCAUAUGCA |
| hsa-miR-4634 | 1726 | CGGCGCGACCGGCCCGGGG | 1727 | CCGGGCCGGUCGCGCCGUU |
| hsa-miR-4635 | 1728 | UCUUGAAGUCAGAACCCGCAA | 1729 | GCGGGUUCUGACUUCAAGAUU |
| hsa-miR-4636 | 1730 | AACUCGUGUUCAAAGCCUUUAG | 1731 | AAAGGCUUUGAACACGAGUUUU |
| hsa-miR-4637 | 1732 | UACUUGAACUGCAGAUUCAAGUGA | 1733 | ACUUGAAUCUGCAGUUAGUAUU |
| hsa-miR-4638 | 1734 | CCUGGACACCGCUCAGCCGGCCG | 1735 | ACUCGGCUGCGGUGGACAAGU |
| hsa-miR-4639 | 1736 | UCACUCUCACCUUGCUUUGC | 1737 | UUGCUAAGUAGGCUGAGAUUGA |
| hsa-miR-4640 | 1738 | UGGGCCAGGGAGCAGCUGGUGGG | 1739 | CACCCCUGUUUCCUGGCCCAC |
| hsa-miR-4641 | 1740 | UGCCCAAAGUAUACUUUUGCCUCA | 1741 | AGGCAAAAGUAUGGCAUGGGCAUU |
| hsa-miR-4642 | 1742 | AUGGCAUCGUCCCCUGGUGGCU | 1743 | CCACCAGGGGACGAUGCCAUUU |
| hsa-miR-4643 | 1744 | GACACAUGACCAUAAAUGCUAA | 1745 | AGCAUUUAUGGUCAUGUGUCUU |
| hsa-miR-4644 | 1746 | UGGAGAGAGAAAAGAGACAGAAG | 1747 | UCUGUCUCUUUUCUCUCUCCAUU |
| hsa-miR-4645 | 1748 | ACCAGGCAAGAAAUAUUGU | 1749 | AGACAGUAAUCUUGCUUGGUU |
| hsa-miR-4646 | 1750 | AUUGUCCCUCUCCCUUCCCAG | 1751 | ACUGGGAAGAGGAGCUGAGGGA |
| hsa-miR-4647 | 1752 | GAAGAUGGUGCUGUGCUGAGGAA | 1753 | CCUCAGCACAGCACCAUCUUCUU |
| hsa-miR-4648 | 1754 | UGUGGGACUGCAAAUGGGGAG | 1755 | CCCAUUUGCAGUCCCACAUU |
| hsa-miR-4649 | 1756 | UGGGCGAGGGUGGGCUCUCAGAG | 1757 | UCUGAGGCUGCCUCUCCCCA |
| hsa-miR-4650 | 1758 | AGGUAGAAUGAGGCCUGACAU | 1759 | UCAGGCCUCUUUCUACCUU |

TABLE 1-continued miRNA Sequences

| miRNA | SEQ ID NO | Sequence 1 | SEQ ID NO | Sequence 2 |
|---|---|---|---|---|
| hsa-miR-4651 | 1760 | CGGGGUGGGUGAGGUCGGGC | 1761 | CCGACCUCACCCACCCCGUU |
| hsa-miR-4652 | 1762 | AGGGGACUGGUUAAUAGAACUA | 1763 | GUUCUGUUAACCCAUCCCCUCA |
| hsa-miR-4653 | 1764 | UCUCUGAGCAAGGCUUAACACC | 1765 | UGGAGUUAAGGGUUGCUUGGAGA |
| hsa-miR-4654 | 1766 | UGUGGGAUCUGGAGGCAUCUGG | 1767 | AGAUGCCUCCAGAUCCCACAUU |
| hsa-miR-4655 | 1768 | ACCCUCGUCAGGUCCCCGGGG | 1769 | CACCGGGGAUGGCAGAGGGUCG |
| hsa-miR-4656 | 1770 | UGGGCUGAGGGCAGGAGGCCUGU | 1771 | AGGCCUCCUGCCCUCAGCCCAUU |
| hsa-miR-4657 | 1772 | AAUGUGGAAGUGGUCUGAGGCAU | 1773 | GCCUCAGACCACUUCCACAUUUU |
| hsa-miR-4658 | 1774 | GUGAGUGUGGAUCCUGGAGGAAU | 1775 | UCCUCCAGGAUCCACACUCACUU |
| hsa-miR-4659a | 1776 | UUUCUUCUUAGACAUGGCAACG | 1777 | CUGCCAUGUCUAAGAAGAAAAC |
| hsa-miR-4659b | 1778 | UUUCUUCUUAGACAUGGCAGCU | 1779 | UUGCCAUGUCUAAGAAGAA |
| hsa-miR-466 | 1780 | AUACACAUACACGCAACACACAU | 1781 | GUGUGUUGCGUGUAUGUGUAUUU |
| hsa-miR-4660 | 1782 | UGCAGCUCUGGUGGAAAAUGGAG | 1783 | CCAUUUUCCACCAGAGCUGCAUU |
| hsa-miR-4661 | 1784 | AACUAGCUCUGUGGAUCCUGAC | 1785 | CAGGAUCCACAGAGCUAGUCCA |
| hsa-miR-4662a | 1786 | UUAGCCAAUUGUCCAUCUUUAG | 1787 | AAAGAUAGACAAUGGCUAAAU |
| hsa-miR-4662b | 1788 | AAAGAUGGACAAUUGGCUAAAU | 1789 | UUAGCCAAUUGUCCAUCUUUUU |
| hsa-miR-4663 | 1890 | AGCUGAGCUCCAUGGACGUGCAGU | 1791 | UGCACGUCCAUGGAGCUCAGCUUU |
| hsa-miR-4664 | 1792 | CUUCCGGUCUGUGAGCCCCGUC | 1793 | UGGGGUGCCCACUCCGCAAGUU |
| hsa-miR-4665 | 1794 | CUCGGCCGCGGCGCGUAGCCCCCGCC | 1795 | CUGGGGACGCGUGAGCGCGAGC |
| hsa-miR-4666a | 1796 | AUACAUGUCAGAUUGUAUGCC | 1797 | CAUACAAUCUGACAUGUAUUU |
| hsa-miR-4666b | 1798 | UUGCAUGUCAGAUUGUAAUUCCC | 1799 | GAAUUACAAUCUGACAUGCAAUU |
| hsa-miR-4667 | 1800 | ACUGGGGAGCAGAAGGAGAACC | 1801 | UCCCUCCUUCUGUCCCCACAG |
| hsa-miR-4668 | 1802 | AGGGAAAAAAAAAAGGAUUUGUC | 1803 | GAAAAUCCUUUUGUUUUUCCAG |
| hsa-miR-4669 | 1804 | UGUGUCCGGGAAGUGGAGGAGG | 1805 | UCCUCCACUUCCCGGACACAUU |
| hsa-miR-4670 | 1806 | AAGCGACCAUGAUGUAACUUCA | 1807 | UGAAGUUACAUCAUGGUCGCUU |
| hsa-miR-4671 | 1808 | ACCGAAGACUGUGCGCUAAUCU | 1809 | UUAGUGCAUAGUCUUUGGUCU |
| hsa-miR-4672 | 1810 | UUACACAGCUGGACAGAGGCA | 1811 | CCUCUGUCCAGCUGUGUAAUU |
| hsa-miR-4673 | 1812 | UCCAGGCAGGAGCCGGACUGGA | 1813 | CAGUCCGGCUCCUGCCUGGAUU |
| hsa-miR-4674 | 1814 | CUGGGCUCGGGACGCGCGGCU | 1815 | CCGCGCGUCCCGAGCCCAGUU |
| hsa-miR-4675 | 1816 | GGGGCUGUGAUUGACCAGCAGG | 1817 | UGCUGGUCAAUCACAGCCCCUU |
| hsa-miR-4676 | 1818 | GAGCCAGUGGUGAGACAGUGA | 1819 | CACUGUUUCACCACUGGCUCUU |
| hsa-miR-4677 | 1820 | UUGUUCUUUGGUCUUUCAGCCA | 1821 | UCUGUGAGACCAAAGAACUACU |
| hsa-miR-4678 | 1822 | AAGGUAUUGUUCAGACUUAUGA | 1823 | AUAAGUCUGAACAAUACCUUUU |
| hsa-miR-4679 | 1824 | UCUGUGAUAGAGAUUCUUUGCU | 1825 | CAAAGAAUCUCUAUCACAGAUU |
| hsa-miR-4680 | 1826 | UCUGAAUUGUAAGAGUUGUUA | 1827 | AGAACUCUUGCAGUCUUAGAUGU |
| hsa-miR-4681 | 1828 | AACGGGAAUGCAGGCUGUAUCU | 1829 | AUACAGCCUGCAUUCCCGUUUU |
| hsa-miR-4682 | 1830 | UCUGAGUUCCUGGAGCCUGGUCU | 1831 | ACCAGGCUCCAGGAACUCAGAUU |
| hsa-miR-4683 | 1832 | UGGAGAUCCAGUGCUCGCCCGAU | 1833 | CGGGCGAGCACUGGAUCUCCAUU |
| hsa-miR-4684 | 1834 | CUCUCUACUGACUUGCAACAUA | 1835 | UGUUGCAAGUCGGUGGAGACGU |
| hsa-miR-4685 | 1836 | CCCAGGGCUUGGAGUGGGGCAAGGUU | 1837 | UCUCCCUUCCUGCCCUGGCUAG |
| hsa-miR-4686 | 1838 | UAUCUGCUGGGCUUUCUGGUGUU | 1839 | CACCAGAAAGCCCAGCAGAUAUU |
| hsa-miR-4687 | 1840 | UGGCUGUUGGAGGGGCCAGGC | 1841 | CAGCCCUCCCCCGCACCCAAA |
| hsa-miR-4688 | 1842 | UAGGGGCAGCAGAGGACCUGGG | 1843 | CAGGUCCUCUGCUGCCCCUAUU |
| hsa-miR-4689 | 1844 | UUGAGGAGACAUGGUGGGGGCC | 1845 | CCCCCACCAUGUCUCCUCAAUU |
| hsa-miR-4690 | 1846 | GCAGCCCAGCUGAGGCCUCUG | 1847 | GAGCAGGCGAGGCUGGGCUGAA |
| hsa-miR-4691 | 1848 | GUCCUCCAGGCCAUGAGCUGCGG | 1849 | CCAGCCAGGACUGAGAGUGCAU |
| hsa-miR-4692 | 1850 | UCAGGCAGUGUGGGUAUCAGAU | 1851 | CUGAUACCCACACUGCCUGAUU |
| hsa-miR-4693 | 1852 | AUACUGUGAAUUUCACUGUCACA | 1853 | UGAGAGUGGAAUUCACAGUAUUU |
| hsa-miR-4694 | 1854 | AGGGUUUAUCCUAUCCAUUUGC | 1855 | CAAAUGGACAGGAUAACACCU |
| hsa-miR-4695 | 1856 | CAGGAGGCAGUGGGCGAGCAGG | 1857 | UGACUCACCGCUGCUCCCUUC |
| hsa-miR-4696 | 1858 | UGCAAGACGGAUACUGUCAUCU | 1859 | AUGACAGUAUCCGUCUUGCAUU |
| hsa-miR-4697 | 1860 | AGGGGGCGCAGUCACUGACGUG | 1861 | UGUCAGUGACUCCUGCCCCUUGGU |
| hsa-miR-4698 | 1862 | UCAAAAUGUAGAGGAAGACCCCA | 1863 | GGGUCUUCCUCUACAUUUUGAUU |
| hsa-miR-4699 | 1864 | AAUUUACUCUGCAAUCUUCUCC | 1865 | AGAAGAUUGCAGAGUAAGUCC |
| hsa-miR-4700 | 1866 | CACAGGACUGACUCCUCACCCCAGUG | 1867 | UCUGGGGAUGAGGACAGUGUGU |
| hsa-miR-4701 | 1868 | UUGGCCACCACACCUACCCCUU | 1869 | AUGGGUGAUGGGUGUGUGU |
| hsa-miR-4703 | 1870 | UGUAGUUGUAUUGUAUUGCCAC | 1871 | UAGCAAUACAGUACAAAUAUAGU |
| hsa-miR-4704 | 1872 | UCAGUCACAUAUCUAGUGUCUA | 1873 | GACACUAGGCAUGUGAGUGAUU |
| hsa-miR-4705 | 1874 | UCAAUCACUUGGUAAUUGCUGU | 1875 | AGCAAUUACCAAGUGAUUGAUU |
| hsa-miR-4706 | 1876 | AGCGGGAGGAAGUGGGCGCUGCUU | 1877 | GCAGCGCCCACUUCCUCCCCGCUUU |
| hsa-miR-4707 | 1878 | AGCCCGCCCCAGCCGAGGUUCU | 1879 | GCCCCGGCGCGGGCGGGUUCGG |
| hsa-miR-4708 | 1880 | AGAGAUGCCGCCUUGCUCCCUU | 1881 | AGCAAGGCGGCAUCUCUCUGAU |
| hsa-miR-4709 | 1882 | ACAACAGUGACUUGCUCUCCAA | 1883 | UUGGAGAGCAAGUGUCUGUAGC |
| hsa-miR-4710 | 1884 | GGGUGAGGGCAGGUGGUU | 1885 | CCACCUGCCCUCACCCUU |
| hsa-miR-4711 | 1886 | CGUGUCUUUCUGGCUUGAU | 1887 | UGCAUCAGGCCAGAAGACAUGAG |
| hsa-miR-4712 | 1888 | AAUGAGAGACCUGUACUGUAU | 1889 | UCCAGUACAGGUCUCUCAUUUC |
| hsa-miR-4713 | 1890 | UUCUCCCACUACCAGGCUCCCA | 1891 | UGGGAUCCAGACAGUGGGAGAA |
| hsa-miR-4714 | 1892 | AACUCUGACCCUUAGGUUGAU | 1893 | CCAACCUAGGUGGUCAGAGUUG |
| hsa-miR-4715 | 1894 | GUGCCACCUUAAACUGCAGCCAU | 1895 | AAGUUGGCUGCAGUUAAGGUGG |
| hsa-miR-4716 | 1896 | AAGGGGAAGGAAACAUGGAGA | 1897 | UCCAUGUUUCCUUCCCCUUCU |
| hsa-miR-4717 | 1898 | ACACAUGGGUGGCUGUGGCCU | 1899 | UAGGCCACAGCCACCCAUGUGU |
| hsa-miR-4718 | 1900 | AGCUGUACCUGAAACCAAGCA | 1901 | CUUGGUUUCAGGUACAGCUUU |
| hsa-miR-4719 | 1902 | UCACAAAUCUAUAAUAUGCAGG | 1903 | UGCAUAUUAUAGAUUUGUGAUU |
| hsa-miR-4720 | 1904 | UGCUUAAGUUGUACCAAGUAU | 1905 | CCUGGCAUAUUUGGUAUAACUU |
| hsa-miR-4721 | 1906 | UGAGGGCUCCAGGUGACGGUGG | 1907 | ACCGUCACCUGGAGCCCUCAUU |
| hsa-miR-4722 | 1908 | GGCAGGAGGGCUGUGCCAGGUUG | 1909 | ACCUGCCAGCACCUCCCUGCAG |

TABLE 1-continued miRNA Sequences

| miRNA | SEQ ID NO | Sequence 1 | SEQ ID NO | Sequence 2 |
|---|---|---|---|---|
| hsa-miR-4723 | 1910 | UGGGGGAGCCAUGAGAUAAGAGCA | 1911 | CCCUCUCUGGCUCCUCCCCAAA |
| hsa-miR-4724 | 1912 | AACUGAACCAGGAGUGAGCUUCG | 1913 | GUACCUUCUGGUUCAGCUAGU |
| hsa-miR-4725 | 1914 | AGACCCUGCCAGCCUUCCCACC | 1915 | UGGGGAAGGCGUCAGUGUCGGG |
| hsa-miR-4726 | 1916 | ACCCAGGUUCCCUCUGGCCGCA | 1917 | AGGGCCAGAGGAGCCUGGAGUGG |
| hsa-miR-4727 | 1918 | AUAGUGGGAAGCUGGCAGAUUC | 1919 | AUCUGCCAGCUUCCACAGUGG |
| hsa-miR-4728 | 1920 | CAUGCUGACCUCCCUCCUGCCCCAG | 1921 | UGGGAGGGGAGAGGCAGCAAGCA |
| hsa-miR-4729 | 1922 | UCAUUUAUCUGUUGGGAAGCUA | 1923 | GCUUCCCAACAGAUAAAUGAUU |
| hsa-miR-4730 | 1924 | CUGGCGGAGCCAUUCCAUGCCA | 1925 | GCAUGGAAUGGGCUCCGCCAGUU |
| hsa-miR-4731 | 1926 | UGCUGGGGGCCACAUGAGUGUG | 1927 | CACACAAGUGGCCCCCAACACU |
| hsa-miR-4732 | 1928 | UGUAGAGCAGGGAGCAGGAAGCU | 1929 | GCCCUGACCUGUCCUGUUCUG |
| hsa-miR-4733 | 1930 | AAUCCCAAUGCUAGACCCGGUG | 1931 | CCACCAGGUCUAGCAUUGGGAU |
| hsa-miR-4734 | 1932 | GCUGCGGGCUGCGGUCAGGGCU | 1933 | CCCUGACCGCAGCCCGCAGCUU |
| hsa-miR-4735 | 1934 | CCUAAUUUGAACACCUUCGGUA | 1935 | AAAGGUGCUCAAAUUAGACAU |
| hsa-miR-4736 | 1936 | AGGCAGGUUAUCUGGGCUG | 1937 | GCCCAGAUAACCUGCUUU |
| hsa-miR-4737 | 1938 | AUGCGAGGAUGCUGACAGUG | 1939 | CUGUCAGCAUCCUCGCAUUU |
| hsa-miR-4738 | 1940 | UGAAACUGGAGCGCCUGGAGGA | 1941 | ACCAGCGCGUUUUCAGUUUCAU |
| hsa-miR-4739 | 1942 | AAGGGAGGAGGAGCGGAGGGGCCCU | 1943 | GGCCCUCCGCUCCUCCUCCCUUUU |
| hsa-miR-4740 | 1944 | GCCCGAGAGGAUCCGUCCCUGC | 1945 | AGGACUGAUCCUCUCGGGCAGG |
| hsa-miR-4741 | 1946 | CGGGCUGUCCGGAGGGGUCGGCU | 1947 | CCGACCCCUCCGGACAGCCCGUU |
| hsa-miR-4742 | 1948 | UCAGGCAAAGGGAUAUUUACAGA | 1949 | UCUGUAUUCUCCUUUGCCUGCAG |
| hsa-miR-4743 | 1950 | UUUCUGUCUUUUCUGGUCCAG | 1951 | UGGCCGGAUGGGACAGGAGGCAU |
| hsa-miR-4744 | 1952 | UCUAAAGACUAGACUUCGCUAUG | 1953 | UAGCGAAGUCUAGUCUUUAGAUU |
| hsa-miR-4745 | 1954 | UGAGUGGGGCUCCCGGGACGGCG | 1955 | UGGCCCGGCGACGUCUCACGGUC |
| hsa-miR-4746 | 1956 | AGCGGUGCUCCUGCGGGCCGA | 1957 | CCGGUCCCAGGAGAACCUGCAGA |
| hsa-miR-4747 | 1958 | AAGGCCCGGGCUUUCCUCCCAG | 1959 | AGGGAAGGAGGCUUGGUCUUAG |
| hsa-miR-4748 | 1960 | GAGGUUUGGGGAGGAUUUGCU | 1961 | CAAAUCCUCCCCAAACCUCUU |
| hsa-miR-4749 | 1962 | UGCGGGGACAGGCCAGGGCAUC | 1963 | CGCCCCUCCUGCCCCCACAG |
| hsa-miR-4750 | 1964 | CCUGACCCACCCCUCCCGCAG | 1965 | CUCGGGCGGAGGUGGUUGAGUG |
| hsa-miR-4751 | 1966 | AGAGGACCCGUAGCUGCUAGAAGG | 1967 | UUCUAGCAGCUACGGGUCCUCUUU |
| hsa-miR-4752 | 1968 | UUGUGGAUCUCAAGGAUGUGCU | 1969 | CACAUCCUUGAGAUCCACAAUU |
| hsa-miR-4753 | 1970 | CAAGGCCAAAGGAAGAGAACAG | 1971 | UUCUCUUUCUUUAGCCUUGUGU |
| hsa-miR-4754 | 1972 | AUGCGGACUCUGGGUUAGCGGAGU | 1973 | UCCGCUAACCCAGGUCCGCAUUU |
| hsa-miR-4755 | 1974 | UUUCCCUUCAGAGCCUGGCUUU | 1975 | AGCCAGGCUCUGAAGGGAAAGU |
| hsa-miR-4756 | 1976 | CCAGAGAUGGUUGCCUUCCUAU | 1977 | CAGGGAGGCGCUCACUCUCUGCU |
| hsa-miR-4757 | 1978 | CAUGACGUCACAGAGGCUUCGC | 1979 | AGGCCUCUGUGACGUCACGGUGU |
| hsa-miR-4758 | 1980 | GUGAGUGGGAGCCGUGGGGCUG | 1981 | UGCCCCACCUGCUGACCACCCUC |
| hsa-miR-4759 | 1982 | UAGGACUAGAUGUUGGAAUUA | 1983 | AUUCCAACACUAGUCCUAUU |
| hsa-miR-4760 | 1984 | AAAUUCAUGUUCAAUCUAAACC | 1985 | UUUAGAUUGAACAUGAAGUUAG |
| hsa-miR-4761 | 1986 | ACAAGGUGUGCAUGCCUGACC | 1987 | GAGGGCAUGCGCACUUUGUCC |
| hsa-miR-4762 | 1988 | CCAAAUCUUGAUCAGAAGCCU | 1989 | CUUCUGAUCAAGAUUUGUGGUG |
| hsa-miR-4763 | 1990 | AGGCAGGGGCUGGUGCUGGGCGGG | 1991 | CGCCUGCCCAGCCCGCUCCUGCU |
| hsa-miR-4764 | 1992 | UUAACUCCUUUCACACCCAUGG | 1993 | UGGAUGUGGAAGGAGUUAUCU |
| hsa-miR-4765 | 1994 | UGAGUGAUUGAUAGCUAUGUUC | 1995 | ACAUAGCUAUCAAUCACUCAUU |
| hsa-miR-4766 | 1996 | UCUGAAAGAGCAGUUGGUGUU | 1997 | AUAGCAAUUGCUCUUUUGGAA |
| hsa-miR-4767 | 1998 | CGCGGGCGCUCCUGGCCGCCGCC | 1999 | CGGCGGCCAGGAGCGCCCGCGU |
| hsa-miR-4768 | 2000 | CCAGGAGAUCCAGAGAGAAU | 2001 | AUUCUCUCUGGAUCCCAUGGAU |
| hsa-miR-4769 | 2002 | UCUGCCAUCCUCCCUCCCCUAC | 2003 | GGUGGGAUGGAGAGAAGGUAUGAG |
| hsa-miR-4770 | 2004 | UGAGAUGACACUGUAGCU | 2005 | CUACAGUGUCAUCUCAUU |
| hsa-miR-4771 | 2006 | AGCAGACUUGACCUACAAUUA | 2007 | AUUGUAGGUCAAGUCUGCUUU |
| hsa-miR-4772 | 2008 | CCUGCAACUUUGCCUGAUCAGA | 2009 | UGAUCAGGCAAAAUUGCAGACU |
| hsa-miR-4773 | 2010 | CAGAACAGGAGCAUAGAAAGGC | 2011 | CUUUCUAUGCUCCUGUUCUGUU |
| hsa-miR-4774 | 2012 | AUUGCCUAACAUGUGCCAGAA | 2013 | UCUGGUAUGUAGUAGGUAAUAA |
| hsa-miR-4775 | 2014 | UUAAUUUUUGUUUCGGUCACU | 2015 | UGACCAACAAAAAAUUAAUU |
| hsa-miR-4776 | 2016 | GUGGACCAGGAUGGCAAGGGCU | 2017 | CUUGCCAUCCUGGUCCACUGCAU |
| hsa-miR-4777 | 2018 | UUCUAGAUGAGAGAUAUAUAUA | 2019 | AUACCUCAUCUAGAAUGCUGUA |
| hsa-miR-4778 | 2020 | UCUUCUUCCUUUGCAGAGUUGA | 2021 | AAUUCUGUAAAGGAAGAAGAGG |
| hsa-miR-4779 | 2022 | UAGGAGGGAAUAGUAAAAGCAG | 2023 | GCUUUUACUAUUCCUCCUAUU |
| hsa-miR-4780 | 2024 | ACCCUUGAGCCUGAUCCUAGC | 2025 | UAGGGAUCAGGCUCAAGGGUUU |
| hsa-miR-4781 | 2026 | UAGCGGGGAUUCCAAUAUUGG | 2027 | AAUGUUGGAAUCCUCGCUAGAG |
| hsa-miR-4782 | 2028 | UGAUUGUCUUCAUAUCUAGAAC | 2029 | UUCUGGAUAUGAAGACAAUCAA |
| hsa-miR-4783 | 2030 | CCCCGGUGUUGGGGCGCGUCGC | 2031 | GGCGCGCCCAGCUCCCGGGCU |
| hsa-miR-4784 | 2032 | UGAGGCAGAUGCUGGGACUGA | 2033 | AGUCCCAGCAUCUCCUCAUU |
| hsa-miR-4785 | 2034 | AGAGUCGGCGACGCCGCCAGC | 2035 | UGGCGGCGUCGCCGACUCUUU |
| hsa-miR-4786 | 2036 | UGAAGCCAGCUCUGGUCUGGGC | 2037 | UGAGACCAGGACUGGAUGCACC |
| hsa-miR-4787 | 2038 | GAUGCGCCGCCCACUGCCCCGCG | 2039 | GCGGGGUGGCGGCGGCAUCCC |
| hsa-miR-4788 | 2040 | UUACGGACCAGCUAAGGGAGGC | 2041 | CUCCCUUAGCUGGUCCGUAAU |
| hsa-miR-4789 | 2042 | GUAUACACCUGAUAUGUGUAUG | 2043 | CACACAUAGCAGGUGUAUAUA |
| hsa-miR-4790 | 2044 | AUCGCUUUACCAUUCAUGUU | 2045 | UGAAUGGUAAAGCGAUGUCACA |
| hsa-miR-4791 | 2046 | UGGAUAUGAUGACUGAAA | 2047 | UCAGUCAUCAUAUCCAUU |
| hsa-miR-4792 | 2048 | CGGUGAGCGCUCGCUGGC | 2049 | CAGCGAGCGCUCACCGUU |
| hsa-miR-4793 | 2050 | ACAUCCUGCUCCACAGGGCAGAGG | 2051 | UCUGCACUGUGAGUUGGCUGGCU |
| hsa-miR-4794 | 2052 | UCUGGCUAUCUCACGAGACUGU | 2053 | AGUCUCGUGAGAUAGCCAGAUU |
| hsa-miR-4795 | 2054 | AGAAGUGGCUAAUAAUAUUGA | 2055 | AUAUUAUUAGCCACUUCGGAU |
| hsa-miR-4796 | 2056 | UAAAGUGGCAGAGUAUAGACAC | 2057 | UGUCUAUACUCUGUCACUUUAC |
| hsa-miR-4797 | 2058 | GACAGAGUGCCACUUACUGAA | 2059 | UCUCAGUAAGUGGCACUCUGU |

TABLE 1-continued miRNA Sequences

| miRNA | SEQ ID NO | Sequence 1 | SEQ ID NO | Sequence 2 |
|---|---|---|---|---|
| hsa-miR-4798 | 2060 | UUCGGUAUACUUUGUGAAUUGG | 2061 | AACUCACGAAGUAUACCGAAGU |
| hsa-miR-4799 | 2062 | AUCUAAAUGCAGCAUGCCAGUC | 2063 | ACUGGCAUGCUGCAUUUAUAUA |
| hsa-miR-4800 | 2064 | CAUCCGUCCGUCUGUCCAC | 2065 | AGUGGACCGAGGAAGGAAGGA |
| hsa-miR-4801 | 2066 | UACACAAGAAAACCAAGGCUCA | 2067 | AGCCUUGGUUUUCUUGUGUAUU |
| hsa-miR-4802 | 2068 | UAUGGAGGUUCUAGACCAUGUU | 2069 | UACAUGGAUGGAAACCUUCAAGC |
| hsa-miR-4803 | 2070 | UAACAUAAUAGUGUGGAUUGA | 2071 | AAUCCACACUAUUAUGUUAUU |
| hsa-miR-4804 | 2072 | UGCUUAACCUUGCCCUCGAAA | 2073 | UUGGACGGUAAGGUUAAGCAA |
| hsa-miR-483 | 2074 | UCACUCCUCUCCUCCCGUCUU | 2075 | AAGACGGGAGGAAAGAAGGGAG |
| hsa-miR-484 | 2076 | UCAGGCUCAGUCCCCUCCCGAU | 2077 | CGGGAGGGGACUGAGCCUGAUU |
| hsa-miR-485 | 2078 | AGAGGCUGGCCGUGAUGAAUUC | 2079 | GUCAUACACGGCUCUCCUCUCU |
| hsa-miR-486 | 2080 | CGGGGCAGCUCAGUACAGGAU | 2081 | UCCUGUACUGAGCUGCCCCGAG |
| hsa-miR-487a | 2082 | GUGGUUAUCCCUGCUGUGUUCG | 2083 | AAUCAUACAGGGACAUCCAGUU |
| hsa-miR-487b | 2084 | GUGGUUAUCCCUGUCCUGUUCG | 2085 | AAUCGUACAGGGUCAUCCACUU |
| hsa-miR-488 | 2086 | UUGAAAGGCUAUUUCUUGGUC | 2087 | CCCAGAUAAUGGCACUCUCAA |
| hsa-miR-489 | 2088 | GUGACAUCACAUAUACGGCAGC | 2089 | GGUCGUAUGUGUGACGCCAUUU |
| hsa-miR-490 | 2090 | CCAUGGAUCUCCAGGUGGGU | 2091 | CAACCUGGAGGACUCCAUGCUG |
| hsa-miR-491 | 2092 | AGUGGGGAACCCUUCCAUGAGG | 2093 | CUUAUGCAAGAUUCCCUUCUAC |
| hsa-miR-492 | 2094 | AGGACCUGCGGGACAAGAUUCUU | 2095 | GAAUCUUGUCCCGCAGGUCCUUU |
| hsa-miR-493 | 2096 | UGAAGGUCUACUGUGUGCCAGG | 2097 | UUGUACAUGGUAGGCUUUCAUU |
| hsa-miR-494 | 2098 | AGGUUGUCCGUGUUGUCUUCUCU | 2099 | UGAAACAUACACGGGAAACCUC |
| hsa-miR-495 | 2100 | GAAGUUGCCCAUGUUAUUUCG | 2101 | AAACAAACAUGGUGCACUUCUU |
| hsa-miR-496 | 2102 | UGAGUAUUACAUGGCCAAUCUC | 2103 | GAUUGGCCAUGUAAUACUCAUU |
| hsa-miR-497 | 2104 | CAGCAGCACACUGUGGUUUGU | 2105 | CAAACCACACUGUGGUGUUAGA |
| hsa-miR-498 | 2106 | UUUCAAGCCAGGGGGCGUUUUUC | 2107 | AAAACGCCCCCUGGCUUGAAAUU |
| hsa-miR-4999 | 2108 | UGCUGUAUUGUCAGGUAGUGA | 2109 | UCACUACCUGACAAUACAGU |
| hsa-miR-499a | 2110 | UUAAGACUUGCAGUGAUGUUU | 2111 | AACAUCACAGCAAGUCUGUGCU |
| hsa-miR-499b | 2112 | ACAGACUUGCUGUGAUGUUCA | 2113 | AACAUCACUGCAAGUCUUAACA |
| hsa-miR-5000 | 2114 | UCAGGACACUUCUGAACUUGGA | 2115 | CAGUUCAGAAGUGUUCCUGAGU |
| hsa-miR-5001 | 2116 | AGGGCUGGACUCAGCGGCGGAGCU | 2117 | UUCUGCCUCUGUCCAGGUCCUU |
| hsa-miR-5002 | 2118 | UGACUGCCUCACUGACCACUU | 2119 | AAUUUGGUUUCUGAGGCACUAGU |
| hsa-miR-5003 | 2120 | UCACAACAACCUUGCAGGGUAGA | 2121 | UACUUUUCUAGGUUGUUGGGG |
| hsa-miR-5004 | 2122 | CUUGGAUUUUCCUGGGCCUCAG | 2123 | UGAGGACAGGGCAAAUUCACGA |
| hsa-miR-5006 | 2124 | UUGCCAGGGCAGGAGGUGGAA | 2125 | UUUCCCUUUCCAUCCUGGCAG |
| hsa-miR-5007 | 2126 | UAGAGUCUGGCUGAUAUGGUUU | 2127 | AUCAUAUGAACCAAACUCUAAU |
| hsa-miR-5008 | 2128 | UGAGGCCCUUGGGGCACAGUGG | 2129 | CCUGUGCUCCCAGGGCCUCGC |
| hsa-miR-5009 | 2130 | UCCUAAAUCUGAAAGUCCAAAA | 2131 | UUGGACUUUUUCAGAUUUGGGAU |
| hsa-miR-500a | 2132 | AUGCACCUGGGCAAGGAUUCUG | 2133 | UAAUCCUUGCUACCUGGGUGAGA |
| hsa-miR-500b | 2134 | AAUCCUUGCUACCUGGGU | 2135 | GCACCCAGGCAAGGAUUCUG |
| hsa-miR-501 | 2136 | AAUGCACCCGGGCAAGGAUUCU | 2137 | AAUCCUUUGUCCCUGGGUGAGA |
| hsa-miR-5010 | 2138 | AGGGGGAUGGCAGAGCAAAAUU | 2139 | UUUUGUGUCUCCCAUUCCCCAG |
| hsa-miR-5011 | 2140 | UAUAUAUACAGCCAUGCACUC | 2141 | GUGCAUGGCUGUAUAUAUAACA |
| hsa-miR-502 | 2142 | AAUGCACCUGGGCAAGGAUUCA | 2143 | AUCCUUGCUAUCUGGGUGCUA |
| hsa-miR-503 | 2144 | UAGCAGCGGGAACAGUUCUGCAG | 2145 | GGGGUAUUGUUUCCGCUGCCAGG |
| hsa-miR-504 | 2146 | GGGAGUGCAGGGCAGGGUUUC | 2147 | AGACCCUGGUCUGCACUCUAUC |
| hsa-miR-5047 | 2148 | UUGCAACUGCGGUUGUAAGGU | 2149 | CUUACAACCGCAGCUGCAAUU |
| hsa-miR-505 | 2150 | CGUCAACACUUGCUGGUUUCCU | 2151 | GGGAGCCAGGAAGUAUUGAUGU |
| hsa-miR-506 | 2152 | UAAGGCACCCUUCUGAGUAGA | 2153 | UAUUCAGGAAGGUGUUACUUAA |
| hsa-miR-507 | 2154 | UUUUGCACCUUUUGGAGUGAA | 2155 | CACUCCAAAAGGUGCAAAAUU |
| hsa-miR-508 | 2156 | UGAUUGUAGCCUUUUGGAGUAGA | 2157 | UACUCCAGAGGGCGUCACUCAUG |
| hsa-miR-5087 | 2158 | GGGUUUGUAGCUUUGCUGGCAUG | 2159 | UGCCAGCAAAGCUACAAACCCUU |
| hsa-miR-5088 | 2160 | UCCCUUCUUCCUGGGCCCUCA | 2161 | CAGGGCUCAGGGAUUGGAUGGAGG |
| hsa-miR-5089 | 2162 | GUGGGAUUUCUGAGUAGCAUC | 2163 | AUGCUACUCGGAAAUCCCACUGA |
| hsa-miR-509-1 | 2164 | UGAUUGGUACGUCUGUGGGUAG | 2165 | UACUGCAGACAGUGGCAAUCA |
| hsa-miR-509-3 | 2166 | UGAUUGGUACGUCUGUGGGUAG | 2167 | UACUGCAGACGUGGCAAUCAUG |
| hsa-miR-5090 | 2168 | CCGGGGCAGAUUGGUGUAGGGUG | 2169 | CCCUACACCAAUCUGCCCCGGUU |
| hsa-miR-5091 | 2170 | ACGGAGACGACAAGACUGUGCUG | 2171 | GCACAGUCUUGUCGUCUCCGUUU |
| hsa-miR-5092 | 2172 | AAUCCACGCUGAGCUUGGCAUC | 2173 | UGCCAAGCUCAGCGUGGAUUUU |
| hsa-miR-5093 | 2174 | AGGAAAUGAGGCUGGCUAGGAGC | 2175 | UCCUAGCCAGCCUCAUUUCCUUU |
| hsa-miR-5094 | 2176 | AAUCAGUGAAUGCCUUGAACCU | 2177 | GUUCAAGGCAUUCACUGAUUUU |
| hsa-miR-5095 | 2178 | UUACAGGCGUGAACCACCGCG | 2179 | CGGUGGUUCACGCCUGUAAUU |
| hsa-miR-5096 | 2180 | GUUUCACCAUGUUGGUCAGGC | 2181 | CUGACCAACAUGGUGAAACUU |
| hsa-miR-510 | 2182 | UACUCAGGAGAGUGGCAAUCAC | 2183 | AUUGAAACCUCUAAGAGUGGA |
| hsa-miR-5100 | 2184 | UUCAGAUCCCAGCGGUGCCUCU | 2185 | AGGCACCGCUGGGAUCUGAAUU |
| hsa-miR-511 | 2186 | GUGUCUUUUGCUCUGCAGUCA | 2187 | AAUGUGUAGCAAAAGACAGA |
| hsa-miR-512 | 2188 | AAGUGCUGUCAUAGCUGAGGUC | 2189 | CACUCAGCCUUGAGGGCACUUUC |
| hsa-miR-513a | 2190 | UAAAUUUCACCUUUCUGAGAAGG | 2191 | UUCACAGGGAGGUGUCAU |
| hsa-miR-513b | 2192 | AAAUGCACCUUUUUGAGAGGA | 2193 | UUCACAAGGAGGUGUCAUUUAU |
| hsa-miR-513c | 2194 | UUCUCAAGGAGGUGUCGUUUAU | 2195 | UAAAUUUCACCUUUCUGAGAAGA |
| hsa-miR-514a | 2196 | AUUGACACUUCUGUGAGUAGA | 2197 | UACUCUGGAGAGUGACAAUCAUG |
| hsa-miR-514b | 2198 | AUUGACACCUCUGUGAGUGGA | 2199 | UUCUCAAGAGGGAGGCAAUCAU |
| hsa-miR-515 | 2200 | GAGUGCCUUCUUUUGGAGCGUU | 2201 | UUCUCCAAAAGAAAGCACUUUCUG |
| hsa-miR-516a | 2202 | UUCUCGAGGAAAGAAGCACUUUC | 2203 | UGCUUCCUUUCAGAGGGU |
| hsa-miR-516b | 2204 | AUCUGGAGGUAAGAAGCACUUU | 2205 | UGCUUCCUUUCAGAGGGU |
| hsa-miR-517a | 2206 | AUCGUGCAUCCCUUUAGAGUGU | 2207 | CCUCUAGAUGGAAGCACUGUCU |
| hsa-miR-517b | 2208 | AUCGUGCAUCCCUUUAGAGUGU | 2209 | CCUCUAGAUGGAAGCACUGUCU |

TABLE 1-continued miRNA Sequences

| miRNA | SEQ ID NO | Sequence 1 | SEQ ID NO | Sequence 2 |
|---|---|---|---|---|
| hsa-miR-517c | 2210 | AUCGUGCAUCCUUUUAGAGUGU | 2211 | CCUCUAGAUGGAAGCACUGUCU |
| hsa-miR-5186 | 2212 | AGAGAUUGGUAGAAAUCAGGU | 2213 | CUGAUUUCUACCAAUCUCUUU |
| hsa-miR-5187 | 2214 | ACUGAAUCCUCUUUUCCUCAG | 2215 | UGGGAUGAGGGAUUGAAGUGGA |
| hsa-miR-5188 | 2216 | AAUCGGACCCAUUUAAACCGGAG | 2217 | CCGGUUUAAAUGGGUCCGAUUUU |
| hsa-miR-5189 | 2218 | UCUGGGCACAGGCGGAUGGACAGG | 2219 | UGCCAACCGUCAGAGCCCAGA |
| hsa-miR-518a | 2220 | GAAAGCGCUUCCCUUUGCUGGA | 2221 | CUGCAAAGGGAAGCCCUUUC |
| hsa-miR-518b | 2222 | CAAAGCGCUCCCCUUUAGAGGU | 2223 | CUCUAAAAGGGGAGCGCUUUGUU |
| hsa-miR-518c | 2224 | CAAAGCGCUUCUCUUUAGAGUGU | 2225 | UCUCUGGAGGGAAGCACUUUCUG |
| hsa-miR-518d | 2226 | CUCUAGAGGGAAGCACUUUCUG | 2227 | CAAAGCGCUUCCCUUUGGAGC |
| hsa-miR-518e | 2228 | CUCUAGAGGGAAGCGCUUUCUG | 2229 | AAAGCGCUUCCCUUCAGAGUG |
| hsa-miR-518f | 2230 | CUCUAGAGGGAAGCACUUUCUC | 2231 | GAAAGCGCUUCUCUUUAGAGG |
| hsa-miR-5190 | 2230 | CCAGUGACUGAGCUGGAGCCA | 2233 | GCUCCAGCUCAGUCACUGGUU |
| hsa-miR-5191 | 2234 | AGGAUAGGAAGAAUGAAGUGCU | 2235 | CACUUCAUUCUUCCUAUCCUUU |
| hsa-miR-5192 | 2236 | AGGAGAGUGGAUUCCAGGUGGU | 2237 | CACCUGGAAUCCACUCUCCUUU |
| hsa-miR-5193 | 2238 | UCCUCCUCUACCUCAUCCCAGU | 2239 | UGGGAUGAGGUAGAGGAGGAUU |
| hsa-miR-5194 | 2240 | UGAGGGGUUUGGAAUGGGAUGG | 2241 | AUCCCAUUCCAAACCCCUCAUU |
| hsa-miR-5195 | 2242 | AACCCCUAAGGCAACUGGAUGG | 2243 | AUCCAGUUCUCUGAGGGGCU |
| hsa-miR-5196 | 2244 | AGGGAAGGGGACGAGGGUUGGG | 2245 | UCAUCCUCGUCUCCCUCCCAG |
| hsa-miR-5197 | 2246 | AAGAAGAGACUGAGUCAUCGAAU | 2247 | CAAUGGCACAAACUCAUUCUUGA |
| hsa-miR-519a | 2248 | CUCUAGAGGGAAGCGCUUUCUG | 2249 | AAAGUGCAUCCUUUUAGAGUGU |
| hsa-miR-519b | 2250 | AAAGUGCAUCCUUUUAGAGGUU | 2251 | CUCUAGAGGGAAGCGCUUUCUG |
| hsa-miR-519c | 2252 | AAAGUGCAUCUUUUUAGAGGAU | 2253 | CUCUAGAGGGAAGCGCUUUCUG |
| hsa-miR-519d | 2254 | CAAAGUGCCUCCCUUUAGAGUG | 2255 | CCUCCAAAGGGAAGCGCUUUCUGUU |
| hsa-miR-519e | 2256 | UUCUCCAAAAGGGAGCACUUUC | 2257 | AAGUGCCUCCUUUUAGAGUGUU |
| hsa-miR-520a | 2258 | AAAGUGCUUCCCUUUGGACUGU | 2259 | CUCCAGAGGGAAGUACUUUCU |
| hsa-miR-520b | 2260 | AAAGUGCUUCCUUUUAGAGGG | 2261 | CUCUAAAAGGAAGCACUUUUU |
| hsa-miR-520c | 2262 | CUCUAGAGGGAAGCACUUUCUG | 2263 | AAAGUGCUUCCUUUUAGAGGGU |
| hsa-miR-520d | 2264 | CUACAAAGGGAAGCCCUUUC | 2265 | AAAGUGCUUCUCUUUGGUGGGU |
| hsa-miR-520e | 2266 | AAAGUGCUUCCUUUUUGAGGG | 2267 | CUCAAAAGGAAGCACUUUUU |
| hsa-miR-520f | 2268 | CCUCUAAAGGGAAGCGCUUUCU | 2269 | AAGUGCUUCCUUUUAGAGGGUU |
| hsa-miR-520g | 2270 | UCUAGAGGAAGCACUUUCUGUUU | 2271 | ACAAAGUGCUUCCCUUUAGAGUGU |
| hsa-miR-520h | 2272 | ACAAAGUGCUUCCCUUUAGAGU | 2273 | UCUAAAGGGAAGCACUUUGUUU |
| hsa-miR-521 | 2274 | AACGCACUUCCCUUUAGAGUGU | 2275 | ACUCUAAAGGGAAGUGCGUUU |
| hsa-miR-522 | 2276 | CUCUAGAGGGAAGCGCUUUCUG | 2277 | AAAAUGGUUCCCUUUAGAGUGU |
| hsa-miR-523 | 2278 | CUCUAGAGGGAAGCGCUUUCUG | 2279 | GAACGCGCUUCCCUAUAGAGGGU |
| hsa-miR-524 | 2280 | GAAGGCGCUUCCCUUUGGAGU | 2281 | CUACAAAGGGAAGCACUUUCUC |
| hsa-miR-525 | 2282 | CUCCAGAGGGAUGCACUUUCU | 2283 | GAAGGCGCUUCCCUUUAGAGCG |
| hsa-miR-526a | 2284 | CUCUAGAGGGAAGCACUUUCUG | 2285 | GAAAGUGCUUCCCUCUAGAGUU |
| hsa-miR-526b | 2286 | GAAAGUGCUUCCUUUUAGAGGC | 2287 | CUCUUGAGGGAAGCACUUUCUG |
| hsa-miR-527 | 2288 | CUGCAAAGGGAAGCCCUUUC | 2289 | AAGGGCUUCCCUUUGCAGUU |
| hsa-miR-532 | 2290 | CCUCCCACACCCAAGGCUUGCA | 2291 | CAUGCCCUUGAGUGUAGGACCGU |
| hsa-miR-539 | 2292 | GGAGAAAUUAUCCUUGGUGUGU | 2293 | AUCAUACAAGGACAAUUUCUUU |
| hsa-miR-541 | 2294 | UGGUGGGCACAGAAUCUGGACU | 2295 | AAAGGAUUCUGCUGUCGGUCCCACU |
| hsa-miR-542 | 2296 | UGUGACAGAUUGAUAACUGAAA | 2297 | UCGGGGAUCAUCAUGUCACGAGA |
| hsa-miR-543 | 2298 | AAACAUUCGCGGUGCACUUCUU | 2299 | GAAGUGCACCGCGAAUGUUUUU |
| hsa-miR-544a | 2300 | AUUCUGCAUUUUUAGCAAGUUC | 2301 | ACUUGCUAAAAAUGCAGAAUUU |
| hsa-miR-544b | 2302 | ACCUGAGGUUGUGCAUUUCUAA | 2303 | AGAAAUGCACAACCUCAGGUUU |
| hsa-miR-545 | 2304 | UCAGUAAAUGUUUAUUAGAUGA | 2305 | UCAGCAAACAUUUAUUGUGUGC |
| hsa-miR-548a | 2306 | CAAAACUGGCAAUUACUUUUGC | 2307 | AAAAGUAAUUGCGAGUUUUACC |
| hsa-miR-548aa | 2308 | AAAACCACAAUUACUUUUGCACCA | 2309 | GUGCAAAAGUAAUUGUGGUUUUUUU |
| hsa-miR-548ab | 2310 | AAAGUAAUUGUGGAUUUUGCU | 2311 | CAAAUCCACAAUUACUUUUUU |
| hsa-miR-548ac | 2312 | CAAAAACCGGCAAUUACUUUUG | 2313 | AAAGUAAUUGCCGGUUUUUGUU |
| hsa-miR-548ad | 2314 | AAAAGUAAUUGUGGUUUUUG | 2315 | GAAAACGACAAUGACUUUUGCA |
| hsa-miR-548ae | 2316 | CAAAACUGCAAUUACUUUCA | 2317 | AAAGUAAUUGUGGUUUUUG |
| hsa-miR-548ag | 2318 | AAAGGUAAUUGUGGUUUCUGC | 2319 | AGAAACCACAAUUACCUUUUU |
| hsa-miR-548ah | 2320 | CAAAAACUGCAGUUACUUUUGC | 2321 | AAAAGUGAUUCAGUGUUUG |
| hsa-miR-548ai | 2322 | AAAGGUAAUUGCAGUUUUUCCC | 2323 | GAAAACUGCAAUUACCUUUUU |
| hsa-miR-548aj | 2324 | UGCAAAAGUAAUUGCAGUUUUU | 2325 | UAAAACUGCAGUUACUUUUA |
| hsa-miR-548ak | 2326 | AAAAGUAACUGCGGUUUUUGA | 2327 | AAAAACCGCAGUUACUUUUUU |
| hsa-miR-548al | 2328 | AACGGCAAUGACUUUUGUACCA | 2329 | GUACAAAAGUCAUUGCCGUUUU |
| hsa-miR-548am | 2330 | AAAAGUAAUUGCGGUUUUUGCC | 2331 | CAAAAACUGCAGUUACUUUUGU |
| hsa-miR-548an | 2332 | AAAAGGCAAUGCUUUUUUG | 2333 | AAAACCACAAUGCUUUUUU |
| hsa-miR-548ao | 2334 | AGAAGUAACUACGGUUUUUGCA | 2335 | AAAGACCGUGACUACUUUUGCA |
| hsa-miR-548ap | 2336 | AAAAGUAAUUGCGGUCUUU | 2337 | AAAAACCACAAUUACUUUU |
| hsa-miR-548aq | 2338 | GAAAGUAAUUGCUGUUUUUGCC | 2339 | CAAAAACUGCAAUUACUUUUGC |
| hsa-miR-548ar | 2340 | AAAAGUAAUUGCAGUUUUUGC | 2341 | UAAAACUGCAAUUACUUUUU |
| hsa-miR-548as | 2342 | UAAAACCCACAAUUAUGUUUGU | 2343 | AAAGUAAUUGCGGGUUUUGCC |
| hsa-miR-548at | 2344 | AAAAGUUAAUUCGGAUGUUUGGCU | 2345 | CAAAACCGCAGUAACUUUUGU |
| hsa-miR-548au | 2346 | UGGCAGUUACUUUUGCACCAG | 2347 | AAAAGUAAUUGCGGUUUUUGC |
| hsa-miR-548av | 2348 | AAACUGCAGUUACUUUUGC | 2349 | AAAGUAACUGCGGAUUU |
| hsa-miR-548aw | 2350 | GUGCAAAAGUCAUCACGGUU | 2351 | CCGUGAUGACUUUUGCACUU |
| hsa-miR-548ax | 2352 | AGAAGUAAUUGCGGUUUUGCCA | 2353 | GCAAAACCGCAAUUACUUCUUU |
| hsa-miR-548ay | 2354 | CAAAACCGCGAUUACUCUUGCA | 2355 | AAAGUAAUUGUGGUUUUUGC |
| hsa-miR-548az | 2356 | AAAAACUGCAAUCACUUUUGC | 2357 | CAAAAGUGAUUGUGGUUUUUGC |
| hsa-miR-548b | 2358 | AAAGUAAUUGUGGUUUUGGCC | 2359 | CAAGAACCUCAGUUGCUUUUGU |

TABLE 1-continued miRNA Sequences

| miRNA | SEQ ID NO | Sequence 1 | SEQ ID NO | Sequence 2 |
|---|---|---|---|---|
| hsa-miR-548ba | 2360 | AAAGGUAACUGUGAUUUUUGCU | 2361 | CAAAAAUCACAGUUACCUUUUU |
| hsa-miR-548bb | 2362 | AAAAGUAACUAUGGUUUUUGCC | 2363 | CAAAAACCAUAGUUACUUUUGC |
| hsa-miR-548c | 2364 | AAAAGUAAUUGCGGUUUUUGCC | 2365 | CAAAAACUCACAUUACUUUUGC |
| hsa-miR-548d | 2366 | CAAAAACCACAGUUUCUUUUGC | 2367 | AAAAGUAAUUGUGGUUUUUGCC |
| hsa-miR-548e | 2368 | AAAAACUGAGACUACUUUUGCA | 2369 | CAAAAGCAAUCGCGGUUUUUGC |
| hsa-miR-548f | 2370 | AAAAACUGUAAUUACUUUU | 2371 | UGCAAAAGUAAUCACAGUUUUU |
| hsa-miR-548g | 2372 | UGCAAAAGUAAUUGCAGUUUUUG | 2373 | AAAACUGUAAUUACUUUUGUAC |
| hsa-miR-548h | 2374 | CAAAAACCGCAAUUACUUUUGCA | 2375 | AAAAGUAACGCGGUUUUUGUC |
| hsa-miR-548i | 2376 | AAAAGUAAUUGCGGAUUUUGCC | 2377 | CAAAAUCCGCAAUUACUUUUUU |
| hsa-miR-548j | 2378 | CAAAAACUGCAUUACUUUUGC | 2379 | AAAAGUAAUUGCGGUCUUUGGU |
| hsa-miR-548k | 2380 | AAAAGUACUUGCGGAUUUUGCU | 2381 | CAAAAUCCGCAAGUACUUUUUU |
| hsa-miR-548l | 2382 | AAAGUAUUUGCGGGUUUUGUC | 2383 | CAAAACCCGCAAAUACUUUUUU |
| hsa-miR-548m | 2384 | CAAAGGUAUUUGUGGUUUUUG | 2385 | AAAACCACAAAUACCUUUGUU |
| hsa-miR-548n | 2386 | CAAAAGUAAUUGUGGAUUUUGU | 2387 | AAAAUCCACAAUUACUUUUGUU |
| hsa-miR-548o | 2388 | CCAAAACUGCAGUUACUUUUGC | 2389 | AAAAGUAAUUGCGUUUUUGCC |
| hsa-miR-548p | 2390 | UAGCAAAAACUGCAGUUACUUU | 2391 | AGUAACUGCAGUUUUUGCUAUU |
| hsa-miR-548q | 2392 | GCUGGUGCAAAAGUAAUGGCGG | 2393 | GCCAUUACUUUUGCACCAGCUU |
| hsa-miR-548s | 2394 | AUGGCCAAAACUGCAGUUAUUUU | 2395 | AAUAACUGCAGUUUUGGCCAUUU |
| hsa-miR-548t | 2396 | AAAAACCACAAUUACUUUUGCACCA | 2397 | CAAAAGUGAUCGUGGUUUUUG |
| hsa-miR-548u | 2398 | CAAAGACUGCAAUUACUUUUGCG | 2399 | AAAAGUAAAUUGCAGUCUUUGUU |
| hsa-miR-548v | 2400 | AGCUACAGUUACUUUUGCACCA | 2401 | GUGCAAAAGUAACUGUAGCUUU |
| hsa-miR-548w | 2402 | AAAAGUAACUGCGGUUUUUGCCU | 2403 | GCAAAAACCGCAGUUACUUUUUU |
| hsa-miR-548x | 2404 | UGCAAAAGUAAUUGCAGUUUUUG | 2405 | UAAAAACUGCAAUUACUUUC |
| hsa-miR-548y | 2406 | AAAAGUAAUCACUGUUUUUGCC | 2407 | CAAAACAGUGAUUACUUUUGUU |
| hsa-miR-548z | 2408 | CAAAAACCGCAAUUACUUUUGCA | 2409 | CAAAAGUAAUUGCGGUUUUUGUU |
| hsa-miR-549a | 2410 | UGACAACUAUGGAUGAGCUCU | 2411 | AGCUCAUCCAUAGUUGUCAUU |
| hsa-miR-550a-1 | 2412 | UGUCUUACUCCCUCAGGCACAU | 2413 | AGUGCCUGAGGGAGUAAGAGCCC |
| hsa-miR-550a-3 | 2414 | UGUCUUACUCCCUCAGGCACAU | 2415 | AGUGCCUGAGGGAGUAAGAG |
| hsa-miR-550b | 2416 | UCUUACUCCCUCAGGCACUG | 2417 | AUGUGCCUGAGGGAGUAAGACA |
| hsa-miR-551a | 2418 | GCGACCCACUCUUGGUUUCCA | 2419 | GAAACCAAGAGUGGGUCGCUU |
| hsa-miR-551b | 2420 | GAAAUCAAGCGUGGGUGAGACC | 2421 | GCGACCCAUACUUGGUUUCAG |
| hsa-miR-552 | 2422 | GUUUAACCUUUUGCCUGUUGG | 2423 | AACAGGUGACUGGUUAGACAA |
| hsa-miR-553 | 2424 | AAAAACGGUGAGAUUUUGUUUU | 2425 | AACAAAAUCUCACCGUUUUUU |
| hsa-miR-554 | 2426 | GCUAGUCCUGACUCAGCCAGU | 2427 | UGGCUGAGUCAGGACUAGCUU |
| hsa-miR-555 | 2428 | AGGGUAAGCUGAACCUCUGAU | 2429 | CAGAGGUUCAGCUUACCCUUU |
| hsa-miR-556 | 2430 | GAUGAGCUCAUUGUAAUAUGAG | 2431 | AUAUUACCAUUAGCUCAUCUUU |
| hsa-miR-557 | 2432 | GUUUGCACGGGUGGGCCUUGUCU | 2433 | ACAAGGCCCACCCGUGCAAACU |
| hsa-miR-5571 | 2434 | GUCCUAGGAGGCUCCCUCUG | 2435 | CAAUUCUCAAAGGAGCCUCCC |
| hsa-miR-5572 | 2436 | GUUGGGGUGCAGGGUCUGCU | 2437 | CAGACCCCUGCACCCCAACUU |
| hsa-miR-5579 | 2438 | UAUGGUACUCCUUAAGCUAAC | 2437 | UUAGCUUAAGGAGUACCAGAUC |
| hsa-miR-558 | 2440 | UGAGCUGCGUACCAAAU | 2441 | UUUGGUACGCAGCUCAUU |
| hsa-miR-5580 | 2442 | CACAUAUGAAGUGAGCCAGCAC | 2443 | UGCUGGCUCAUUUCAUAUGUGU |
| hsa-miR-5581 | 2444 | AGCCUUCCAGGAGAAAUGGAGA | 2445 | UUCCAUGCCUCCUAGAAGUUCC |
| hsa-miR-5582 | 2446 | UAAAACUUUAAGUGUGCCUAGG | 2447 | UAGGCACACUUAAAGUUUAUGC |
| hsa-miR-5583 | 2448 | GAAUAUGGGUAUAUUAGUUUGG | 2449 | AAACUAAUAUACCCAUAUUCUG |
| hsa-miR-5584 | 2450 | CAGGGAAAUGGGAAGAACUAGA | 2451 | UAGUUCUUCCCUUUGCCCAAUU |
| hsa-miR-5585 | 2452 | CUGAAUAGCUGGGACUACAGGU | 2453 | UGAAGUACCAGCUACUCGAGAG |
| hsa-miR-5586 | 2454 | UAUCCAGCUUGUUACUAUAUGC | 2455 | CAGAGUGACAAGCUGGUUAAAG |
| hsa-miR-5587 | 2456 | AUGGUCACCUCCGGGACU | 2457 | GCCCGGGCAGUGUGAUCAUC |
| hsa-miR-5588 | 2458 | ACUGGCAUUAGUGGGACUUUU | 2459 | AAGUCCCACUAAUGCCAGC |
| hsa-miR-5589 | 2460 | GGCUGGGUGCUCUUGUGCAGU | 2461 | UGCACAUGGCAACCUAGCUCCCA |
| hsa-miR-559 | 2462 | UAAAGUAAAUAUGCACCAAAA | 2463 | UUGGUGCAUAUUUACUUUAUU |
| hsa-miR-5590 | 2464 | AAUAAAGUUCAUGUAUGGCAA | 2465 | UUGCCAUACAUAGACAUUUAUU |
| hsa-miR-5591 | 2466 | UGGGAGCUAAGCUAUGGGUAU | 2467 | AUACCCAUAGCUUAGCUCCCA |
| hsa-miR-561 | 2468 | CAAAGUUUAAGAUCCUUGAAGU | 2469 | AUCAAGGAUCUUAAACUUUGCC |
| hsa-miR-562 | 2470 | AAAGUAGCUGUACCAUUUGC | 2471 | AAAUGGUACAGCUACUUUUU |
| hsa-miR-563 | 2472 | AGGUUGACAUACGUUUCCC | 2473 | GAAACGUAUGUCAACCUUU |
| hsa-miR-564 | 2474 | AGGCACGGUGUCAGCAGGC | 2475 | CUGCUGACACCGUGCCUUU |
| hsa-miR-566 | 2476 | GGGCGCCUGUGAUCCCAAC | 2477 | UGGGAUCACAGGCGCCCUU |
| hsa-miR-567 | 2478 | AGUAUGUUCUUCCAGGACAGAAC | 2479 | UCUGUCCUGGAAGAACAUACUUU |
| hsa-miR-568 | 2480 | AUGUAUAAAUGUAUACACAC | 2481 | GUGUAUACAUUUAUACAUUU |
| hsa-miR-5680 | 2482 | GAGAAUGCUGGACUAAUCUGC | 2483 | AGAUUAGUCCAGCAUUCUCUCU |
| hsa-miR-5681a | 2484 | AGAAGGGUGGCAAUACCUCUU | 2485 | GAGGUAUUGCCACCCUUUCUUU |
| hsa-miR-5681b | 2486 | AGGUAUUGCCACCCUUUCUAGU | 2487 | UAGAAAGGGUGGCAAUACCUUU |
| hsa-miR-5682 | 2488 | GUAGCACCUUGCAGGAUAAGGU | 2489 | CUUAUCCUGCAAGGUGCUACUU |
| hsa-miR-5683 | 2490 | UACAGAUGCAGAUUCUCUGACUUC | 2491 | AGUCAGAGAAUCUGCAUCUGUAUU |
| hsa-miR-5684 | 2482 | AACUCUAGCCUGAGCAACAG | 2493 | GUUGCUCAGGCUAGAGUUUU |
| hsa-miR-5685 | 2494 | ACAGCCCAGCAGUUAUCACGGG | 2495 | CGUGAUAACUGCUGGGCUGUUU |
| hsa-miR-5687 | 2496 | UUAGAACGUUUUAGGGUCAAAU | 2497 | UUGACCCUAAAACGUUCUAAUU |
| hsa-miR-5688 | 2498 | UAACAAACACCUGUAAAACAGC | 2499 | UGUUUUACAGGUGUUUGUUAUU |
| hsa-miR-5689 | 2500 | AGCAUACACCUGUAGUCCUAGA | 2501 | UAGGACUACAGGUGUAUGCUUU |
| hsa-miR-569 | 2502 | AGUUAAUGAAUCCUGGAAAGU | 2503 | UUUCCAGGAUUCAUUAACUUU |
| hsa-miR-5690 | 2504 | UCAGCUACUACCUCUAUUAGG | 2505 | UAAUAGAGGUAGUAGCUGAUU |
| hsa-miR-5691 | 2506 | UUGCUCUGAGCUCCGAGAAAGC | 2507 | UUUCUCGGAGCUCAGAGCAAUU |
| hsa-miR-5692a | 2508 | CAAAUAAUACCACAGUGGGUGU | 2509 | ACCCACUGUGGUAUUAUUUGUU |

TABLE 1-continued miRNA Sequences

| miRNA | SEQ ID NO | Sequence 1 | SEQ ID NO | Sequence 2 |
|---|---|---|---|---|
| hsa-miR-5692b | 2510 | AAUAAUAUCACAGUAGGUGU | 2511 | ACCUACUGUGAUAUUAUUUU |
| hsa-miR-5692c | 2512 | AAUAAUAUCACAGUAGGUGUAC | 2513 | ACACCUACUGUGAUAUUAUUUU |
| hsa-miR-5693 | 2514 | GCAGUGGCUCUGAAAUGAACUC | 2515 | GUUCAUUUCAGAGCCACUGCUU |
| hsa-miR-5694 | 2516 | CAGAUCAUGGGACUGUCUCAG | 2517 | GAGACAGUCCCAUGAUCUGUU |
| hsa-miR-5695 | 2518 | ACUCCAAGAAGAAUCUAGACAG | 2519 | GUCUAGAUUCUUCUUGGAGUUU |
| hsa-miR-5696 | 2520 | CUCAUUUAAGUAGUCUGAUGCC | 2521 | CAUCAGACUACUUAAAUGAGUU |
| hsa-miR-5697 | 2522 | UCAAGUAGUUUCAUGAUAAAGG | 2523 | UUUAUCAUGAAACUACUUGAUU |
| hsa-miR-5698 | 5524 | UGGGGGAGUGCAGUGAUUGUGG | 2525 | ACAAUCACUGCACUCCCCCAUU |
| hsa-miR-5699 | 2526 | UCCUGUCUUUCCUUGUUGGAGC | 2527 | UGCCCCAACAAGGAAGGACAAG |
| hsa-miR-570 | 2528 | CGAAAACAGCAAUUACCUUUGC | 2529 | AAAGGUAAUUGCAGUUUUUCCC |
| hsa-miR-5700 | 2530 | UAAUGCAUUAAAUUAUUGAAGG | 2531 | UUCAAUAAUUUAAUGCAUUAUU |
| hsa-miR-5701 | 2532 | UUAUUGUCACGUUCUGAUU | 2533 | UCAGAACGUGACAAUAAUU |
| hsa-miR-5702 | 2534 | UGAGUCAGCAACAUAUCCCAUG | 2535 | UGGGAUAUGUUGCUGACUCAUU |
| hsa-miR-5703 | 2536 | AGGAGAAGUCGGGAAGGU | 2537 | CUUCCCGACUUCUCCUUU |
| hsa-miR-5704 | 2538 | UUAGGCCAUCAUCCCAUUAUGC | 2539 | AUAAUGGGAUGAUGGCCUAAUU |
| hsa-miR-5705 | 2540 | UGUUUCGGGGCUCAUGGCCUGUG | 2541 | CAGGCCAUGAGCCCCGAAACAUU |
| hsa-miR-5706 | 2542 | UUCUGGAUAACAUGCUGAAGCU | 2543 | CUUCAGCAUGUUAUCCAGAAUU |
| hsa-miR-5707 | 2544 | ACGUUUGAAUGCUGUACAAGGC | 2545 | CUUGUACAGCAUUCAAACGUUU |
| hsa-miR-5708 | 2546 | AUGAGCGACUGUGCCUGACC | 2547 | UCAGGCACAGUCGCUCAUUU |
| hsa-miR-571 | 2548 | UGAGUUGGCCAUCUGAGUGAG | 2549 | CACUCAGAUGGCCAACUCACA |
| hsa-miR-572 | 2550 | GUCCGCUCGGCGGUGGCCCA | 2551 | GGCCACCGCCGAGCGGACUU |
| hsa-miR-573 | 2552 | CUGAAGUGAUGUGUAACUGAUCAG | 2553 | GAUCAGUUACACAUCACUUCAGUU |
| hsa-miR-5739 | 2554 | GCGGAGAGAAUGGGGAGC | 2555 | UCCCCAUUCUCUCCGCUU |
| hsa-miR-574 | 2556 | UGAGUGUGUGUGUGUGAGUGUGU | 2557 | CACGCUCAUGCACACACCCACA |
| hsa-miR-575 | 2558 | GAGCCAGUUGGACAGGAGC | 2559 | UCCUGUCCAACUGGCUCUU |
| hsa-miR-576 | 2560 | AAGAUGUGGAAAAAUUGGAAUC | 2561 | AUUCUAAUUUCUCCACGUCUUU |
| hsa-miR-577 | 2562 | UAGAUAAAAUAUUGGUACCUG | 2563 | GGUACCAAUAUUUUAUCUAUU |
| hsa-miR-578 | 2564 | CUUCUUGUGCUCUAGGAUUGU | 2565 | AAUCCUAGAGCACAAGAAGUU |
| hsa-miR-5787 | 2566 | GGGCUGGGGCGCGGGGAGGU | 2567 | CUCCCCGCGCCCCAGCCCUU |
| hsa-miR-579 | 2568 | UUCAUUUGGUAUAAACCGCGAUU | 2569 | UCGCGGUUUGUGCCAGAUGACG |
| hsa-miR-580 | 2570 | UAAUGAUUCAUCAGACUCAGAU | 2571 | UUGAGAAUGAUGAAUCAUUAGG |
| hsa-miR-581 | 2572 | UCUUGUGUUCUCUAGAUCAGU | 2573 | UGAUCUAGAGAACACAAGAUU |
| hsa-miR-582 | 2574 | UUACAGUUGUUCAACCAGUUACU | 2575 | UAACUGGUUGAACAACUGAACC |
| hsa-miR-583 | 2576 | CAAAGAGGAAGGUCCCAUUAC | 2577 | AAUGGGACCUUCCUCUUUGUU |
| hsa-miR-584 | 2578 | UUAUGGUUUGCCUGGGACUGAG | 2579 | UCAGUUCCAGGCCAACCAGGCU |
| hsa-miR-585 | 2580 | UGGGCGUAUCUGUAUGCUA | 2581 | CUAGCACACAGAUACGCCCAGA |
| hsa-miR-586 | 2582 | UAUGCAUUAUAUUUUUAGGUCC | 2583 | ACCUAAAAAAUACAAUGCAUAUU |
| hsa-miR-587 | 2584 | UUUCCAUAGGUGAUGAGUCAC | 2585 | GACUCAUCACCUAUGGAAAUU |
| hsa-miR-588 | 2586 | UUGGCCACAAUGGGUUAGAAC | 2587 | UCUAACCCAUUGUGGCCAAUU |
| hsa-miR-589 | 2588 | UCAGAACAAAUGCCGGUUCCCAGA | 2589 | UGAGAACCACGUCUGCUCUGAG |
| hsa-miR-590 | 2590 | GAGCUUAUUCAUAAAAGUGCAG | 2591 | UAAUUUUAUGUAUAAGCUAGU |
| hsa-miR-591 | 2592 | AGACCAUGGGUUCUCAUUGU | 2593 | AAUGAGAACCCAUGGUCUUU |
| hsa-miR-592 | 2594 | UUGUGUCAAUAUGCGAUGAUGU | 2595 | AUCAUCGCAUAUUGACACAAUU |
| hsa-miR-593 | 2596 | UGUCUCUGCUGGGGUUUCU | 2597 | AGGCACCAGCCAGGCAUUGCUCAGC |
| hsa-miR-595 | 2598 | GAAGUGUGCCGUGGUGUGUCU | 2599 | ACACACCACGCACACUUCGU |
| hsa-miR-596 | 2600 | AAGCCUGCCCGGCUCCUCGGG | 2601 | CGAGGAGCCGGGCAGGCUUUU |
| hsa-miR-597 | 2602 | UGGUUCUCUUGUGGCUCAAGCGU | 2603 | UGUGUCACUCGAUGACCACUGU |
| hsa-miR-598 | 2604 | UACGUCAUCGUUGUCAUCGUCA | 2605 | GCGGUGAUCCCGAUGGUGUGAGC |
| hsa-miR-599 | 2606 | GUUGUGUCAGUUUAUCAAAC | 2607 | UUGAUAAACUGACACAACUU |
| hsa-miR-600 | 2608 | ACUUACAGACAAGAGCCUUGCUC | 2609 | GCAAGGCUCUUGUCUGUAAGUUU |
| hsa-miR-601 | 2610 | UGGUCUAGGAUUGUUGGAGGAG | 2611 | CCUCCAACAAUCCUAGACCAUU |
| hsa-miR-602 | 2612 | GACACGGGCGACAGCUGCGGCCC | 2613 | GCCGCAGCUGUCGCCCGUGUCUU |
| hsa-miR-603 | 2614 | CACACACUGCAAUUACUUUUGC | 2613 | AAAAGUAAUUGCAGUGUGUGUU |
| hsa-miR-604 | 2614 | AGGCUGCGAAUUCAGGAC | 2615 | CCUGAAUUCCGCAGCCUUU |
| hsa-miR-605 | 2618 | AGAAGGCACUAUGAGAUUUAGA | 2617 | UAAAUCCCAUGGUGCCUUCUCCU |
| hsa-miR-606 | 2620 | AAACUACUGAAAAUCAAAGAU | 2619 | CUUUGAUUUUCAGUAGUUUU |
| hsa-miR-6068 | 2622 | CCUGCGAGUCUCCGGCGGUGG | 2621 | ACCGCCGGAGACUCGCAGGUU |
| hsa-miR-6069 | 2624 | GGGCUAGGGCCUGCUGCCCC | 2623 | GGGCAGCAGGCCCUAGCCCUU |
| hsa-miR-607 | 2626 | GUUCAAAUCCAGAUCUAUAAC | 2625 | UAUAGAUCUGGAUUUGAACUU |
| hsa-miR-6070 | 2628 | CCGGUUCCAGUCCCUGGAG | 2627 | CCAGGGACUGGAACCGGUU |
| hsa-miR-6071 | 2630 | UUCUGCUGCCGGCCAAGGC | 2629 | CUUGGCCGGCAGCAGAAUU |
| hsa-miR-6072 | 2632 | UCCUCACACACUGCACCUUAG | 2631 | AAGGUGCAGUGUGAUGAGGAUU |
| hsa-miR-6073 | 2634 | GGUAGUGAGUUAUCAGCUAC | 2633 | AGCUGAUAACUCACUACCUU |
| hsa-miR-6074 | 2636 | GAUAUUCAGAGGCUAGGUGG | 2635 | ACCUAGCCUCUGAAUAUCUU |
| hsa-miR-6075 | 2638 | ACGGCCAGGCGGCAUUGGUG | 2637 | CCAAUGCCGCCUGGGCCGUUU |
| hsa-miR-6076 | 2640 | AGCAUGACAGAGGAGGUGG | 2641 | ACCUCCUCUGUCAUGCUUU |
| hsa-miR-6077 | 2642 | GGGAAGAGCUGUACGGCCUUC | 2643 | AGGCCGUACAGCUCUUCCCUU |
| hsa-miR-6078 | 2644 | CCGCCUGAGCUAGCUGUGG | 2645 | ACAGCUAGCUCAGGCGGUU |
| hsa-miR-6079 | 2646 | UUGGAAGCUUGGACCAACUAGCUG | 2647 | GCUAGUUGGUCCAAGCUUCCAAUU |
| hsa-miR-608 | 2648 | AGGGGUGGUGUUGGGACAGCUCCGU | 2649 | GGAGCUGUCCCAACACCACCCCUUU |
| hsa-miR-6080 | 2650 | UCUAGUGCGGGCGUUCCCG | 2651 | GGAACGCCCGCACUAGAUU |
| hsa-miR-6081 | 2652 | AGGAGCAGUGCCGGCCAAGGCGCC | 2653 | CGCCUUGGCCGGCACUGCUCCUUU |
| hsa-miR-6082 | 2654 | GAAUACGUCUGGUUGAUCC | 2655 | AUCAACCAGACGUAUUCUU |
| hsa-miR-6083 | 2656 | CUUAUAUCAGAGGCUGUGGG | 2657 | CACAGCCUCUGAUAUAAGUU |
| hsa-miR-6084 | 2658 | UUCCGCCAGUCGGUGGCCGG | 2659 | GGCCACCGACUGGCGGAAUU |

TABLE 1-continued miRNA Sequences

| miRNA | SEQ ID NO | Sequence 1 | SEQ ID NO | Sequence 2 |
|---|---|---|---|---|
| hsa-miR-6085 | 2660 | AAGGGGCUGGGGGAGCACA | 2661 | UGCUCCCCCAGCCCCUUUU |
| hsa-miR-6086 | 2662 | GGAGGUUGGGAAGGGCAGAG | 2663 | CUGCCCUUCCCAACCUCCUU |
| hsa-miR-6087 | 2664 | UGAGGCGGGGGGGCGAGC | 2665 | UCGCCCCCCGCCCUCAUU |
| hsa-miR-6088 | 2666 | AGAGAUGAAGCGGGGGGGCG | 2667 | CCCCCCGCUUCAUCUCUUU |
| hsa-miR-6089 | 2668 | GGAGGCCGGGGUGGGGCGGGGCGG | 2669 | GCCCCGCCCCACCCCGGCCUCCUU |
| hsa-miR-609 | 2670 | AGGGUGUUUCUCUCAUCUCU | 2671 | AGAUGAGAGAAACACCCUUU |
| hsa-miR-6090 | 2672 | GGGGAGCGAGGGGCGGGC | 2673 | CCCGCCCCUCGCUCCCCUU |
| hsa-miR-610 | 2674 | UGAGCUAAAUGUGUGCUGGGA | 2675 | CCAGCACACAUUUAGCUCAUU |
| hsa-miR-611 | 2676 | GCGAGGACCCCUCGGGGUCUGAC | 2677 | CAGACCCCGAGGGGUCCUCGCUU |
| hsa-miR-612 | 2678 | GCUGGGCAGGGCUUCUGAGCUCCUU | 2679 | GGAGCUCAGAAGCCCUGCCCAGCUU |
| hsa-miR-6124 | 2680 | GGGAAAAGGAAGGGGGAGGA | 2681 | CUCCCCCUUCCUUUUCCCUU |
| hsa-miR-6125 | 2682 | GCGAAGGCGGAGCGGCGGA | 2683 | CCGCCGCUCCGCCUUCCGCUU |
| hsa-miR-6126 | 2684 | GUGAAGGCCCGGCGGAGA | 2685 | UCCGCCGGGCCUUCACUU |
| hsa-miR-6127 | 2686 | UGAGGGAGUGGGUGGGAGG | 2687 | UCCCACCCACUCCCUCAUU |
| hsa-miR-6128 | 2688 | ACUGGAAUUGGAGUCAAAA | 2689 | UUGACUCCAAUUCCAGUUU |
| hsa-miR-6129 | 2690 | UGAGGGAGUUGGGUGUAUA | 2691 | UACACCCAACUCCCUCAUU |
| hsa-miR-613 | 2692 | AGGAAUGUUCCUUCUUUGCC | 2693 | CAAAGAAGGAACAUUCCUUU |
| hsa-miR-6130 | 2694 | UGAGGGAGUGGAUUGUAUG | 2695 | UACAAUCCACUCCCUCAUU |
| hsa-miR-6131 | 2696 | GGCUGGUCAGAUGGGAGUG | 2697 | CUCCCAUCUGACCAGCCUU |
| hsa-miR-6132 | 2698 | AGCAGGGCUGGGGAUUGCA | 2699 | CAAUCCCCAGCCCUGCUUU |
| hsa-miR-6133 | 2700 | UGAGGGAGGAGGUUGGGUA | 2701 | CCCAACCUCCUCCCUCAUU |
| hsa-miR-6134 | 2702 | UGAGGUGGUAGGAUGUAGA | 2703 | UACAUCCUACCACCUCAUU |
| hsa-miR-614 | 2701 | GAACGCCUGUUCUUGCCAGGUGG | 2705 | ACCUGGCAAGAACAGGCGUUCUU |
| hsa-miR-615 | 2706 | GGGGGUCCCCGGUGCUCGGAUC | 2707 | UCCGAGCCCGGGGUCUCCCUCUU |
| hsa-miR-616 | 2708 | ACUCAAAACCCUUCAGUGACUU | 2709 | AGUCAUUGGAGGGUUUGAGCAG |
| hsa-miR-6165 | 2710 | CAGCAGGAGGUGAGGGGAG | 2711 | CCCCUCACCUCCUGCUGUU |
| hsa-miR-617 | 2712 | AGACUUCCCAUUUGAAGGUGGC | 2713 | CACCUUCAAAUGGGAAGUCUUU |
| hsa-miR-618 | 2714 | AAACUCUACUUGUCCUUCUGAGU | 2715 | UCAGAAGGACAAGUAGAGUUUUU |
| hsa-miR-619 | 2716 | GCUGGGAUUACAGGCAUGAGCC | 2717 | GACCUGGACAUGUUUGUGCCCAGU |
| hsa-miR-620 | 2718 | AUGGAGAUAGAUAUAGAAAU | 2719 | UUCUAUAUCUAUCUCCAUUU |
| hsa-miR-621 | 2720 | GGCUAGCAACAGCGCUUACCU | 2721 | GUAAGCGCUGUUGCUAGCCUU |
| hsa-miR-622 | 2722 | ACAGUCUGCUGAGGUUGGAGC | 2723 | UCCAACCUCAGCAGACUGUUU |
| hsa-miR-623 | 2724 | AUCCCUUGCAGGGGCUGUUGGGU | 2725 | CCAACAGCCCCUGCAAGGGAUUU |
| hsa-miR-624 | 2726 | UAGUACCAGUACCUUGUGUUCA | 2727 | CACAAGGUAUUGGUAUUACCU |
| hsa-miR-625 | 2728 | AGGGGGAAAGUUCUAUAGUCC | 2729 | GACUAUAGAACUUCCCCCUCA |
| hsa-miR-626 | 2730 | AGCUGUCUGAAAAUGUCUU | 2731 | GACAUUUUCAGACAGCUUU |
| hsa-miR-627 | 2732 | UCUUUUCUUUGAGACUCACU | 2733 | GUGAGUCUCUAAGAAAAGAGGA |
| hsa-miR-628 | 2734 | UCUAGUAAGAGUGGCAGUCGA | 2735 | AUGCUGACAUAUUUACUAGAGG |
| hsa-miR-629 | 2736 | UGGGUUUACGUUGGGAGAACU | 2737 | GUUCUCCCAACGUAAGCCCAGC |
| hsa-miR-630 | 2738 | AGUAUUCUGUACCAGGGAAGGU | 2739 | CUUCCCUGGUACAGAAUACUUU |
| hsa-miR-631 | 2740 | AGACCUGGCCCAGACCUCAGC | 2741 | UGAGGUCUGGGCCAGGUCUUU |
| hsa-miR-632 | 2742 | GUGUCUGCUUCCUGUGGGA | 2743 | CCACAGGAAGCAGACACUU |
| hsa-miR-633 | 2744 | CUAAUAGUAUCUACCACAAUAAA | 2745 | UAUUGUGGUAGAUACUAUUAGUU |
| hsa-miR-634 | 2746 | AACCAGCACCCCAACUUUGGAC | 2747 | CCAAAGUUGGGGUGCUGGUUUU |
| hsa-miR-635 | 2748 | ACUUGGGCACUGAAACAAUGUCC | 2749 | ACAUUGUUUACAGUGCCCAAGUU |
| hsa-miR-636 | 2750 | UGUGCUUGCUCGUCCCGCCCGCA | 2751 | CGGGCGGGACGAGCAAGCACAUU |
| hsa-miR-637 | 2752 | ACUGGGGGCUUUCGGGCUCUGCGU | 2753 | GCAGAGCCCGAAAGCCCCCAGUUU |
| hsa-miR-638 | 2754 | AGGGAUCGCGGGCGGGUGGCGGCCU | 2755 | GCCGCCACCCGCCCGCGAUCCCUUU |
| hsa-miR-639 | 2756 | AUCGCUGCGGUUGCGAGCGCUGU | 2757 | AGCGCUCGCAACCGCAGCGAUUU |
| hsa-miR-640 | 2758 | AUGAUCCAGGAACCUGCCUCU | 2759 | AGGCAGGUUCCUGGAUCAUUU |
| hsa-miR-641 | 2760 | AAAGACAUAGGAUAGAGUCACCUC | 2761 | GGUGACUCUAUCCUAUGUCUUUUU |
| hsa-miR-642a | 2762 | GUCCCUCUCCAAAUGUGUCUUG | 2763 | AGACACAUUUGGAGAGGGAACC |
| hsa-miR-642b | 2764 | GGUUCCCUCUCCAAAUGUGUCU | 2765 | AGACACAUUUGGAGAGGGACC |
| hsa-miR-643 | 2766 | ACUUGUAUGCUAGCUCAGGUAG | 2767 | ACCUGAGCUAGCAUACAAGUUU |
| hsa-miR-644a | 2768 | AGUGUGGCUUUCUUAGAGC | 2769 | UCUAAGAAAGCCACACUUU |
| hsa-miR-645 | 2770 | UCUAGGCUGGUACUGCUGA | 2771 | AGCAGUACCAGCCUAGAUU |
| hsa-miR-646 | 2772 | AAGCAGCUGCCUCUGAGGC | 2773 | CUCAGAGGCAGCUGCUUUU |
| hsa-miR-647 | 2774 | GUGGCUGCACUCACUUCCUUC | 2775 | AGGAAGUGAGUGCAGCCACUU |
| hsa-miR-648 | 2776 | AAGUGUGCAGGGCACUGGU | 2777 | CAGUGCCCUGCACACUUUU |
| hsa-miR-649 | 2778 | AAACCUGUGUUGUUCAAGAGUC | 2779 | CUCUUGAACAACAGGUUUUUU |
| hsa-miR-6499 | 2780 | AGCAGUGUUUGUUUUGCCCACA | 2781 | UCGGGCGCAAGAGCACUGCAGU |
| hsa-miR-650 | 2782 | AGGAGGCAGCGCUCUCAGGAC | 2783 | CCUGAGACGCUGCUCCCUUU |
| hsa-miR-6500 | 2784 | ACACUUGUUGGGAUGACCUGC | 2785 | AGGAGCUAUCCACUCCAGGUGUCC |
| hsa-miR-6501 | 2786 | CCAGAGCAGCCUGCGGUAACAGU | 2787 | AGUUGCCAGGGCUGCCUUUGGU |
| hsa-miR-6502 | 2788 | AGCUCUAGAAAGAUUGUUGACC | 2879 | UAGACCAUCUUUCUAGAGUAU |
| hsa-miR-6503 | 2790 | GGGUCUGUAGGAUGCAGACCUCC | 2791 | AGGUCUGCAUUCAAAUCCCCAGA |
| hsa-miR-6504 | 2792 | CAUUACAGCACAGCCAUUCU | 2793 | UCUGGCUGUGCUGUAAUGCAG |
| hsa-miR-6505 | 2794 | UGACUUCUACCUCUUCCAAAG | 2795 | UUGGAUAGGGGAUAUCUCAGC |
| hsa-miR-6506 | 2796 | ACUGGGGAUGUCACUGAAUAUGGU | 2797 | UCGUAUCAGAGAUUCCAGACAC |
| hsa-miR-6507 | 2798 | CAAAGUCCUUCCUAUUUUUCC | 2799 | GAAGAAAUAGGAGGACUUUUG |
| hsa-miR-6508 | 2800 | UCUAGAAAUGCAUGACCCACC | 2801 | UGGGCCAUGCAUUUCUAGAACU |
| hsa-miR-6509 | 2802 | AUUAGGUAGUGGCAGUGGAAC | 2803 | UUCCACUGCCACUACCUAAUUU |
| hsa-miR-651 | 2804 | UUUAGGAUAAGCUUGACUUUUG | 2805 | AAAGGAAAGUGUAUCCUAAAAG |
| hsa-miR-6510 | 2086 | CAGCAGGGGAGAGAGAGGAGUC | 2087 | CACCGACUCUGUCUCCUGCAG |
| hsa-miR-6511a | 2808 | CAGGCAGAAGUGGGGCUGACAGG | 2809 | CCUCACCAUCCCUUCUGCCUGC |

TABLE 1-continued miRNA Sequences

| miRNA | SEQ ID NO | Sequence 1 | SEQ ID NO | Sequence 2 |
|---|---|---|---|---|
| hsa-miR-6511b | 2810 | CUGCAGGCAGAAGUGGGGCUGACA | 2811 | CCUCACCACCCCUUCUGCCUGCA |
| hsa-miR-6512 | 2812 | UACCAUUAGAAGAGCUGGAAGA | 2813 | UUCCAGCCCUUCUAAUGGUAGG |
| hsa-miR-6513 | 2814 | UUUGGGAUUGACGCCACAUGUCU | 2815 | UCAAGUGCAUCUGUCCCUAG |
| hsa-miR-6514 | 2816 | CUGCCUGUUCUUCCACUCCAG | 2817 | UAUGGAGUGGACUUUCAGCUGGC |
| hsa-miR-6515 | 2818 | UCUCUUCAUCUACCCCCCAG | 2819 | UUGGAGGGUGUGGAAGACAUC |
| hsa-miR-6516 | 2820 | UUUGCAGUAACAGGUGUGAGCA | 2821 | AUCAUGUAUGAUACUGCAAACA |
| hsa-miR-652 | 2822 | AAUGGCGCCACUAGGGUUGUG | 2823 | CAACCCUAGGAGAGGGUGCCAUUCA |
| hsa-miR-653 | 2824 | GUGUUGAAACAAUCUCUACUG | 2825 | UUCACUGGAGUUUGUUUCAAUA |
| hsa-miR-654 | 2826 | UGGUGGGCCGCAGAACAUGUGC | 2827 | UAUGUCUGCUGACCAUCACCUU |
| hsa-miR-655 | 2828 | AGAGGUUAUCCGUGUUAUGUUC | 2829 | AUAAUACAUGGUUAACCUCUUU |
| hsa-miR-656 | 2830 | AGGUUGCCUGUGAGGUGUUCA | 2831 | AAUAUUAUACAGUCAACCUCU |
| hsa-miR-657 | 2832 | GGCAGGUUCUCACCCUCUCUAGG | 2833 | UAGAGAGGGUGAGAACCUGCUU |
| hsa-miR-658 | 2834 | GGCGGAGGGAAGUAGGUCCGUUGGU | 2835 | CAACGGACCUACUUCCCUCCGCCUU |
| hsa-miR-659 | 2836 | AGGACCUUCCCUGAACCAAGGA | 2837 | CUUGGUUCAGGGAGGGUCCCCA |
| hsa-miR-660 | 2838 | ACCUCCUGUGUGCAUGGAUUA | 2839 | UACCCAUUGCAUAUCGGAGUUG |
| hsa-miR-661 | 2840 | UGCCUGGGUCUCUGGCCUGCGCGU | 2841 | GCGCAGGCCAGAGACCCAGGCAUU |
| hsa-miR-662 | 2842 | UCCCACGUUGUGGCCCAGCAG | 2843 | GCUGGGCCACAACGUGGGAUU |
| hsa-miR-663a | 2844 | AGGCGGGGCGCCGCGGGACCGC | 2845 | GGUCCCGCGGCGCCCCGCCUUU |
| hsa-miR-663b | 2846 | GGUGGCCCGGCCGUGCCUGAGG | 2847 | UCAGGCACGGCCGGGCACCUU |
| hsa-miR-664a | 2848 | ACUGGCUAGGGAAAAUGAUUGGAU | 2849 | UAUUCAUUUAUCCCCAGCCUACA |
| hsa-miR-664b | 2850 | UUCAUUUGCCUCCCAGCCUACA | 2851 | UGGGCUAAGGGAGAUGAUUGGGUA |
| hsa-miR-665 | 2852 | ACCAGGAGGCUGAGGCCCCU | 2853 | GGGCCUCAGCCUCCUGGUUU |
| hsa-miR-668 | 2854 | UGUCACUCGGCUCGGCCCACUAC | 2855 | UGCGCCUCGGGUGAGCAUG |
| hsa-miR-670 | 2856 | UUUCCUCAUAUUCAUUCAGGA | 2857 | GUCCCAUGUGUAUGUGGUG |
| hsa-miR-671 | 2858 | UCCGGUUCUCAGGGCUCCACC | 2859 | AGGAAGCCCUGGAGGGGCUGGAG |
| hsa-miR-6715a | 2860 | CCAAACCAGUCGUGCCUGUGG | 2861 | ACAGGCACGACUGGUUUGGUU |
| hsa-miR-6715b | 2862 | CUCAAACCGGCUGUGCCUGUGG | 2863 | ACAGGCACGACUGGUUUGGCA |
| hsa-miR-6716 | 2864 | UGGGAAUGGGGGUAAGGGCC | 2865 | UCCGAACUCUCCAUUCCUCUGC |
| hsa-miR-6717 | 2866 | AGGCGAUGUGGGGAUGUAGAGA | 2867 | UCUACAUCCCCACAUCGCCUUU |
| hsa-miR-6718 | 2868 | UAGUGGUCAGAGGGCUUAUGA | 2869 | AUAAGCCCUCUGACCACUAUU |
| hsa-miR-6719 | 2870 | UCUGACAUCAGUGAUUCUCCUG | 2871 | GGAGAAUCACUGAUGUCAGAUU |
| hsa-miR-6720 | 2872 | UUCCAGCCCUGGUAGGCGCCGCG | 2873 | CGCGCCUGCAGGAACUGGUAGA |
| hsa-miR-6721 | 2874 | UGGGCAGGGGCUUAUUGUAGGAG | 2875 | CCUACAAUAAGCCCCUGCCCAUU |
| hsa-miR-6722 | 2876 | UGCAGGGGUCGGGUGGGCCAGG | 2877 | AGGCGCACCCGACCACAUGC |
| hsa-miR-6723 | 2878 | AUAGUCCGAGUAACGUCGGGGC | 2879 | CCCGACGUUACUCGGACUAUUU |
| hsa-miR-6724 | 2880 | CUGGGCCCGCGGCGGGCGUGGGG | 2881 | CCACGCCCGCCGCGGGCCCAGUU |
| hsa-miR-6726 | 2882 | CGGGAGCCUGGGGUCUGCAGGU | 2883 | CUCGCCUGUCUCCCGCUAG |
| hsa-miR-6727 | 2884 | UCCUGCCACCUCCUCCGCAG | 2885 | CUCGGGGCAGGCGGCUGGGAGCG |
| hsa-miR-6728 | 2886 | UCUCUGCUCUGCUCUCCCCAG | 2887 | UUGGAUGGUAGGACCAGAGGGG |
| hsa-miR-6729 | 2888 | UCAUCCCCCUCGCCCUCUCAG | 2889 | UGGGCGAGGGCGGCUGAGCGGC |
| hsa-miR-6730 | 2890 | AGAAAGGUGGAGGGGUUGUCAGA | 2891 | CCUGACACCCCAUCUGCCCUCA |
| hsa-miR-6731 | 2892 | UGGGAGAGCAGGGUAUUGUGGA | 2893 | UCUAUUCCCCACUCUCCCCAG |
| hsa-miR-6732 | 2894 | UAGGGGGUGGCAGGCUGGCC | 2895 | UAACCCUGUCCUCUCCCUCCCAG |
| hsa-miR-6733 | 2896 | UCAGUGUCUGGAUUUCCUAG | 2897 | UGGGAAAGACAAACUCAGAGUU |
| hsa-miR-6734 | 2898 | CCCUUCCCUCACUCUUCUCUCAG | 2899 | UUGAGGGGUAGAAUGAGGUGGAGA |
| hsa-miR-6735 | 2900 | AGGCCUGUGGCUCCUCCCUCAG | 2901 | CAGGGCAGAGGGCACAGGAAUCUGA |
| hsa-miR-6736 | 2902 | UCAGCUCCUCUCUACCCACAG | 2803 | CUGGGUGAGGGCAUCUGUGGU |
| hsa-miR-6737 | 2904 | UUGGGGUGGUCGGCCCUGGAG | 2905 | UCUGUGCUUCACCCCUACCCAG |
| hsa-miR-6738 | 2906 | CUUCUGCCUGCAUUCUACUCCCAG | 2907 | CGAGGGGUAGAAGAGCACAGGGG |
| hsa-miR-6739 | 2908 | AUUGUUCUGUCUUUCUCCCAG | 2909 | UGGGAAAGAGAAAGAACAAGUA |
| hsa-miR-6740 | 2910 | UGUCUUCUCUCCUCCCAAACAG | 2911 | AGUUUGGGAUGGAGAGGAGA |
| hsa-miR-6741 | 2915 | UCGGCUCUCUCCCUCACCCUAG | 2913 | GUGGGUGCUGGUGGGAGCCGUG |
| hsa-miR-6742 | 2914 | AGUGGGUUGGGACCCAGCUGUU | 2915 | ACCUGGGUGUCCCCUCUAG |
| hsa-miR-6743 | 2916 | AAGGGGCAGGGACGGGUGGCCC | 2917 | AGCCGCUCUUCUCCCUGCCCACA |
| hsa-miR-6744 | 2918 | GGGCUCUCUUGUCAUCCUGCAG | 2919 | UGGAUGACAGUGGAGGCCU |
| hsa-miR-6745 | 2920 | UGGGUGGAAGAAGGUCUGGUU | 2921 | CCAGACCUUCUUCCACCCAUU |
| hsa-miR-6746 | 2922 | CCGGGAGAAGGAGGUGGCCUGG | 2923 | CAGCCGCCGCCUGUCUCCACAG |
| hsa-miR-6747 | 2924 | UCCUGCCUUCCUCUGCCACCAG | 2925 | AGGGGUGUGGGAAAGAGGCAGAACA |
| hsa-miR-6748 | 2926 | UCCUGUCCCUGUCUCCUACAG | 2927 | UGUGGGUGGGAAGGACUGGAUU |
| hsa-miR-6749 | 2928 | UCGGGCCUGGGGUUGGGGAGC | 2929 | CUCCUCCCUGCCUGGCCCAG |
| hsa-miR-675 | 2930 | UGGUGCGGAGAGGGCCCACAGUG | 2931 | CUGUAUGCCCUCACCGCUCA |
| hsa-miR-6750 | 2932 | CAGGGAACCAGCUGGGUGAGCGCU | 2933 | GAACUCACCACUGCUCCCAG |
| hsa-miR-6751 | 2934 | UUGGGGGUGAGGUUGGUGUCUGG | 2935 | ACUGAGCCUCUCUCUCUCCAG |
| hsa-miR-6752 | 2936 | UCCCUGCCCCCAUACUCCCAG | 2937 | GGGGGGUGUGGAGCCAGGGGC |
| hsa-miR-6753 | 2938 | UGGUCUGUCUCUGCCCUGGCAC | 2939 | CACCAGGGCAGAGCAGGGCUGA |
| hsa-miR-6754 | 2940 | UCUUCACCUGCCUCUGCCUGCA | 2941 | CCAGGAGUGCUGGUUUGGAGGA |
| hsa-miR-6755 | 2942 | UGUUGUCAUGUUUUUUCCCUAG | 2943 | UAGGGUAGACACUGACAACGUU |
| hsa-miR-6756 | 2944 | UCCCCUUCCUCCCUGCCCAG | 2945 | AGGGUGGGGCUGGAGGUGGGCU |
| hsa-miR-6757 | 2946 | UAGGGAUGGGAGGCCAGGAUGA | 2947 | AACACUGGCCUUGCUAUCCCCA |
| hsa-miR-6758 | 2948 | ACUCAUUCUCCUCUGUCCAG | 2949 | UAGAGGGGAAGGAUGAUGAUGU |
| hsa-miR-6759 | 2950 | UUGUGGGUGGGCAGAAGUCUGU | 2594 | UGACCUUUGCCUCUCCCCUCAG |
| hsa-miR-676 | 2952 | CUGUCCUAAGGUUGUUGAGUU | 2953 | UCUUCAACCUCAGGACUUGCA |
| hsa-miR-6760 | 2954 | CAGGGAGAAGGUGGAAGUGCAGA | 2955 | ACACUGUCCCUUCUCCCCAG |
| hsa-miR-6761 | 2956 | UCUGAGAGCUCGAUGGCAG | 2957 | UCCUACGCUGCUCUCUCACUCC |
| hsa-miR-6762 | 2958 | CGGGGCCAUGGAGCAGCCUGUGU | 2959 | UGGCUGCUUCCCUUGGUCUCCAG |

TABLE 1-continued miRNA Sequences

| miRNA | SEQ ID NO | Sequence 1 | SEQ ID NO | Sequence 2 |
|---|---|---|---|---|
| hsa-miR-6763 | 2960 | CUGGGGAGUGGCUGGGGAG | 2961 | CUCCCCGGCCUCUGCCCCCAG |
| hsa-miR-6764 | 2962 | UCUCUGGUCUUUCCUUGACAG | 2963 | UCCCAGGGUCUGGUCAGAGUUG |
| hsa-miR-6765 | 2964 | UCACCUGGCUGGCCCGCCCAG | 2965 | GUGAGGCCGGGGCCAGGAGGGUGUGU |
| hsa-miR-6766 | 2966 | CGGGUGGGAGCAGAUCUUAUUGAG | 2967 | UGAUUGUCUUCCCCCACCCUCA |
| hsa-miR-6767 | 2968 | UCGCAGACAGGGACACAUGGAGA | 2969 | CCACGUGCUUCUCUUUCCGCAG |
| hsa-miR-6768 | 2970 | CAAAGGCCACAUUCUCCUGUGCAC | 2971 | CACACAGGAAAAGCGGGGCCCUG |
| hsa-miR-6769a | 2972 | GAGCCCCUCUCUGCUCUCCAG | 2973 | AGGUGGGUAUGGAGGAGCCCU |
| hsa-miR-6769b | 2974 | UGGUGGGUGGGGGAGGAGAAGUGC | 2975 | CCCUCUCUGUCCCACCCAUAG |
| hsa-miR-6770 | 2976 | UGAGAAGGCACAGCUUGCACGUGA | 2977 | CUGGCGGCUGUGUCUUCACAG |
| hsa-miR-6771 | 2978 | CUCGGGAGGGCAUGGGCCAGGC | 2979 | CAAACCCCUGUCUACCCGCAG |
| hsa-miR-6772 | 2980 | UGGGUGUAGGCUGGAGCUGAGG | 2981 | UUGCUCCUGACUCUGUGCCCACA |
| hsa-miR-6773 | 2982 | ACUGUCACUUCUCUGCCCAUAG | 2983 | UUGGGCCCAGGAGUAAAACAGGAU |
| hsa-miR-6774 | 2984 | ACUUGGGCAGGAGGGACCCUGUAUG | 2985 | UCGUGUCCCUCUUUGUCCACAG |
| hsa-miR-6775 | 2986 | AGGCCCUGUCCUCUGCCCCAG | 2987 | UCGGGGCAUGGGGGAGGGAGGCUGG |
| hsa-miR-6776 | 2988 | UCUGGGUGCAGUGGGGGUU | 2898 | CAACCACCACUGUCUCUCCCCAG |
| hsa-miR-6777 | 2990 | UCCACUCUCCUGGCCCCAG | 2991 | ACGGGGAGUCAGGCAGUGGUGGA |
| hsa-miR-6778 | 2992 | UGCCUCCCUGACAUUCCACAG | 2993 | AGUGGGAGGACAGGAGGCAGGU |
| hsa-miR-6779 | 2994 | AAGCCCUGUCUCCUCCCAUCU | 2995 | CUGGGAGGGGCUGGGUUUGGC |
| hsa-miR-6780a | 2996 | CUCCUCUGUUUUCUUUCCUAG | 2997 | UUGGGAGGGAAGACAGCUGGAGA |
| hsa-miR-6780b | 2998 | UCCCUGUCUCCUUUCCCUAG | 2999 | UGGGGAAGGCUCAGGCAGGGGAAGA |
| hsa-miR-6781 | 3000 | CGGGCCGGAGGUCAAGGGCGU | 3001 | UGCCUCUUUUCCACGGCCUCAG |
| hsa-miR-6782 | 3002 | UAGGGGUGGGGGAAUUCAGGGGUGU | 3003 | CACCUUUGUGUCCCCAUCCUGCA |
| hsa-miR-6783 | 3004 | UUCCUGGGCUUCUCCUCUGUAG | 3005 | UAGGGGAAAAGUCCUGAUCCGG |
| hsa-miR-6784 | 3006 | UCUCACCCCAACUCUGCCCAG | 3007 | GCCGGGGCUUUGGGUGAGGG |
| hsa-miR-6785 | 3008 | ACAUCGCCCACCUUCCCAG | 3009 | UGGGAGGGCGUGGAUGAUGGUG |
| hsa-miR-6786 | 3010 | UGACGCCCCUUCUGAUUCUGCCU | 3011 | GCGGUGGGGCCGGAGGGGCGU |
| hsa-miR-6787 | 3012 | UCUCAGCUGCUGCCCUCUCCAG | 3013 | UGGCGGGGGUAGAGCUGGCUGC |
| hsa-miR-6788 | 3014 | CUGGGAGAAGAGUGGUGAAGA | 3015 | UUCGCCACUUCCCUCCCUGCAG |
| hsa-miR-6789 | 3016 | CGGCGCCCGUGUCUCCUCCAG | 3017 | GUAGGGGCGUCCCGGGCGCGCGGG |
| hsa-miR-6790 | 3018 | GUGAGUGUGGAUUUGGCGGGGUU | 3019 | CGACCUCGGCGACCCCUCACU |
| hsa-miR-6791 | 3020 | CCCCUGGGGCUGGGCAGGCGGA | 3021 | UGCCUCCUUGGUCUCCGGCAG |
| hsa-miR-6792 | 3022 | CUCCUCCACAGCCCCUGCUCAU | 3023 | GUAAGCAGGGGCUCUGGGGUGA |
| hsa-miR-6793 | 3024 | UGUGGGUUCUGGGUUGGGGUGA | 3025 | UCCCCAACCCCUGCCCGCAG |
| hsa-miR-6794 | 3026 | CAGGGGGACUGGGGUGAGC | 3027 | CUCACUCUCAGUCCCUCCCU |
| hsa-miR-6795 | 3028 | UGGGGGGACAGGAUGAGAGGCUGU | 3029 | ACCCCUCGUUUCUUCCCCCAG |
| hsa-miR-6796 | 3030 | GAAGCUCUCCCCUCCCCGCAG | 3031 | UUGUGGGGUUGGAGAGCUGGCUG |
| hsa-miR-6797 | 3032 | UGCAUGACCCUUCCUCUCCCCAC | 3033 | AGGAGGGAAGGGGCUGAGAACAGGA |
| hsa-miR-6798 | 3034 | CCAGGGGGAUGGGCGAGCUUGGG | 3035 | CUACCCCCAUCCCCCUGUAG |
| hsa-miR-6799 | 3036 | GGGGAGGUGUGCAGGGCUGG | 3037 | UGCCCUGCAUGGUGUCCCCACAG |
| hsa-miR-6800 | 3038 | GUAGGUGACAGUCAGGGGCGG | 3039 | CACCUCUCCUGGCAUCGCCCC |
| hsa-miR-6801 | 3040 | UGGUCAGAGGCAGCAGGAAAUGA | 3041 | ACCCCUGCACACUCACUGGCC |
| hsa-miR-6802 | 3042 | UUCACCCCUCUCACCUAAGCAG | 3043 | CUAGGUGGGGGCUUGAAGC |
| hsa-miR-6803 | 3044 | UCCCUCGCCUUCUCACCCUCAG | 3045 | CUGGGGGUGGGGGCUGGGCGU |
| hsa-miR-6804 | 3046 | UGAGGGUGUCAGCAGGUGACG | 3047 | CGCACCUGCCUCUCACCCACAG |
| hsa-miR-6805 | 3048 | UUGCUCUGCUCCCCCGCCCCAG | 3049 | UAGGGGGCUUGUGGAGUGU |
| hsa-miR-6806 | 3050 | UGAAGCUCUGACAUUCCUGCAG | 3051 | UGUAGGCAUGAGGCAGGGCCAGG |
| hsa-miR-6807 | 3052 | GUGAGCCAGUGGAAUGGAGAGG | 3053 | CACUGCAUUCCUGCUUGGCCCAG |
| hsa-miR-6808 | 3054 | CAGGCAGGGAGGUGGGACCAUG | 3055 | GUGUGACCACCGUUCCUGCAG |
| hsa-miR-6809 | 3056 | CUUCUCUUCUCUCUCCUUCCCAG | 3057 | UGGCAAGGAAAGAAGAGGAUCA |
| hsa-miR-6810 | 3058 | AUGGGGACAGGGAUCAGCAUGGC | 3059 | UCCCCUGCUCCCUUGUUCCCCAG |
| hsa-miR-6811 | 3060 | AGCCUGUGCUUGUCCCUGCAG | 3061 | AUGCAGGCUGUGUACAGCACU |
| hsa-miR-6812 | 3062 | AUGGGGUGAGAUGGGGAGGAGCAGC | 3063 | CCGCUCUUCCCUGACCCCAG |
| hsa-miR-6813 | 3064 | CAGGGGCUGGGGUUUCAGGUUCU | 3065 | AACCUUGGCCCUCUCCCCAG |
| hsa-miR-6814 | 3066 | ACUCGCAUCCUUCCCUUGGCAG | 3067 | UCCCAAGGGUGAGAUGCUGCCA |
| hsa-miR-6815 | 3068 | UAGGUGGCGCCGGAGGAGUCAUU | 3069 | UGGCUUCUCUUGCACACCCAG |
| hsa-miR-6816 | 3070 | UGGGGCGGGGCAGGUCCCUGC | 3071 | GAAGGACCUGCACCUUCG |
| hsa-miR-6817 | 3072 | UCUGCCAUAGGAAGCUUGGAGUGG | 3073 | UCUCUCUGACUCCAUGGCA |
| hsa-miR-6818 | 3074 | UUGUGUGAGUACAGAGAGCAUC | 3075 | UUGCUCUUGUUCCUCACACAG |
| hsa-miR-6819 | 3076 | UUGGGGUGGAGGGCCAAGGAGC | 3077 | AAGCUCUCGUCCCCACCCCAG |
| hsa-miR-6820 | 3078 | UGCGGCAGAGCUGGGGUCA | 3079 | UGUGACUUCUCCCCUGCCACAG |
| hsa-miR-6821 | 3080 | GUGCGUGGUGGCUCGAGGCGGGG | 3081 | UGACCUCUCCGCUCCGCACAG |
| hsa-miR-6822 | 3082 | AGGCUCUAACUGGCUUUCCCUGCA | 3083 | CAGGGAACCAGUUGGGGCUU |
| hsa-miR-6823 | 3084 | UCAGGGUUGGUAGGGGUUGCU | 3085 | UGAGCCUCUCCUUCCCUCCAG |
| hsa-miR-6824 | 3086 | GUAGGGGAGGUUGGGCCAGGGA | 3087 | UCUCUGGUCUUGCCACCCCAG |
| hsa-miR-6825 | 3088 | GCGCUGACCCGCCUUCUCCGCA | 3089 | UGGGGAGGUGUGGAGUCAGCAU |
| hsa-miR-6826 | 3090 | CUCCCUCUCUUUCCUGUUCAG | 3091 | UCAAUAGGAAAGAGGUGGGACCU |
| hsa-miR-6827 | 3092 | UGGGAGCCAUGAGGGUCUGUGC | 3093 | ACCGUCUCUUCUGUUCCCAG |
| hsa-miR-6828 | 3094 | AUCUGCUCUCUGUGUUCCCAG | 3095 | AGGAAGCAAGAGAACCCUGUGG |
| hsa-miR-6829 | 3096 | UGGGCUGCUGAGAAGGGGCA | 3097 | UGCCUCCUCCGUGGCCUCAG |
| hsa-miR-6830 | 3098 | CCAAGGAAGGAGGCUGGACAUC | 3099 | UGUCUUUCUUUCUCUCCCCUUGCAG |
| hsa-miR-6831 | 3100 | UAGGUAGAGUGUGAGGAGGAGGUC | 3101 | UGACUAACUCCCACUCUACAG |
| hsa-miR-6832 | 3102 | AGUAGAGAGGAAAAGUUAGGGUC | 3103 | ACCCUUUUGUCUCUUUCCCAG |
| hsa-miR-6833 | 3104 | UUUCUCUCUCCACUUCCUCAG | 3105 | GUGUGGAAGAUGGGAGGAGAAA |
| hsa-miR-6834 | 3106 | GUGAGGGACUGGGAUUUGUGG | 3107 | UAUGUCCCAUCCCUCCAUCA |
| hsa-miR-6835 | 3108 | AGGGGGUAGAAAGUGGCUGAAG | 3108 | AAAAGCACUUUUCUGUCUCCCAG |

TABLE 1-continued miRNA Sequences

| miRNA | SEQ ID NO | Sequence 1 | SEQ ID NO | Sequence 2 |
|---|---|---|---|---|
| hsa-miR-6836 | 3110 | AUGCCUCCCCCGGCCCCGCAG | 3111 | CGCAGGGCCCUGGCGCAGGCAU |
| hsa-miR-6837 | 3112 | ACCAGGGCCAGCAGGGAAUGU | 3113 | CCUUCACUGUGACUCUGCUGCAG |
| hsa-miR-6838 | 3114 | AAGCAGCAGUGGCAAGACUCCU | 3115 | AAGUCCUGCUUCUGUUGCAG |
| hsa-miR-6839 | 3116 | UCUGGAUUGAAGAGACGACCCA | 3117 | UUGGGUUUUCUCUUCAAUCCAG |
| hsa-miR-6840 | 3118 | ACCCCCGGGCAAAGACCUGCAGAU | 3119 | GCCCAGGACUUUGUGCGGGGUG |
| hsa-miR-6841 | 3120 | UAGGGUACUCAGAGCAAGUUGU | 3121 | ACCUUGCAUCUGCAUCCCCAG |
| hsa-miR-6842 | 3122 | UGGGGGUGGUCUCUAGCCAAGG | 3123 | UUGGCUGGUCUCUGCUCCGCAG |
| hsa-miR-6843 | 3124 | AUGGUCUCCUGUUCUCUGCAG | 3125 | GCAGAGAACAGGAGACCAUUU |
| hsa-miR-6844 | 3126 | UUCUUUGUUUUUAAUUCACAG | 3127 | GUGAAUUAAAAACAAAGAAUU |
| hsa-miR-6845 | 3128 | CGGGGCCAGAGCAGAGAGC | 3129 | CCUCUCCUCCCUGUGCCCCAG |
| hsa-miR-6846 | 3130 | UGACCCCUUCUGUCUCCCUAG | 3131 | UGGGGGCUGGAUGGGGUAGAGU |
| hsa-miR-6847 | 3123 | GGCUCAUGUGUCUGUCCUCUUC | 3133 | ACAGAGGACAGUGGAGUGUGAGC |
| hsa-miR-6848 | 3134 | UGGGGGCUGGGAUGGGCCAUGGU | 3135 | GUGGUCUCUUGGCCCCCAG |
| hsa-miR-6849 | 3136 | ACCAGCUGUGUCCACCUCCAG | 3137 | GAGUGGAUAGGGGAGUGUGUGGA |
| hsa-miR-6850 | 3138 | CCCGCCGGAACGCCGCACU | 3139 | GUGCGGAACGCUGGCCGGGGCG |
| hsa-miR-6851 | 3140 | AGGAGGUGGUACUAGGGGCCAGC | 3141 | UGGCCCUUUGUACCCCUCCAG |
| hsa-miR-6852 | 3142 | CCCUGGGGUUCUGAGGACAUG | 3143 | UGUCCUCUGUUCCUCAG |
| hsa-miR-6853 | 3144 | AGCGUGGGAUGUCCAUGAAGUCAG | 3145 | UGUUCAUUGGAACCCUGCGCAG |
| hsa-miR-6854 | 3146 | UGCGUUUCUCCUCUUGAGCAG | 3147 | AAGCUCAGGUUUGAGAACUGCUGA |
| hsa-miR-6855 | 3148 | AGACUGACCUUCAACCCCACAG | 3149 | UUGGGGUUUUGGGGUGCAGACAUUGC |
| hsa-miR-6856 | 3150 | UACAGCCCUGUGAUCUUUCCAG | 3151 | AAGAGAGGAGCAGUGGUGCUGUGG |
| hsa-miR-6857 | 3152 | UGACUGAGCUUCUCCCCACAG | 3153 | UUGGGGAUUGGGUCAGGCCAGU |
| hsa-miR-6858 | 3154 | CAGCCAGCCCCUGCUCACCCCU | 3155 | GUGAGGAGGGGCUGGCAGGGAC |
| hsa-miR-6859 | 3156 | UGACCCCCAUGUCGCCUCUGUAG | 3157 | GAGAGAACAUGGGCUCAGGACA |
| hsa-miR-6860 | 3158 | ACUGGGCAGGGCUGUGGUGAGU | 3159 | UCACCACAGCCCUGCCCAGUUU |
| hsa-miR-6861 | 3160 | ACUGGGUAGGUGGGGCUCCAGG | 3161 | UGGACCUCUCCUCCCAG |
| hsa-miR-6862 | 3162 | CCUCACCCAGCUCUCUGGCCCUCU | 3163 | CGGGCAUGCUGGGAGAGACUUU |
| hsa-miR-6863 | 3164 | UAGACGUGGUGAAGGAUUGAGUG | 3165 | CUCAACCUUCACCACGUCUAUU |
| hsa-miR-6864 | 3166 | UUGAAGGGACAAGUCAGAUAUGCC | 3167 | GUGAGACUUCUCUCCCUUCAG |
| hsa-miR-6865 | 3168 | ACACCCUCUUUCCCUACCGCC | 3169 | UAGGUGGCAGAGGAGGGACUUCA |
| hsa-miR-6866 | 3170 | GAUCCCUUUAUCUGUCCUCUAG | 3171 | UUAGAGGCUGGAAUAGAGAUUCU |
| hsa-miR-6867 | 3172 | UGUGUGUGUAGAGGAAGAAGGGA | 3173 | CUCUCCCUCUUUACCCACUAG |
| hsa-miR-6868 | 3174 | ACUGGCAGAACACUGAAGCAGC | 3175 | UUCCUUCUGUUGUCUGUGCAG |
| hsa-miR-6869 | 3176 | GUGAGUAGUGGCGCGCGGCGGC | 3177 | CGCCGCGCGCAUCGGCUCAGC |
| hsa-miR-6870 | 3178 | UGGGGGAGAUGGGGUUGA | 3179 | GCUCAUCCCCAUCUCCUUUCAG |
| hsa-miR-6871 | 3180 | CAUGGAGUUCGGGGUGGUUGC | 3181 | CAGCACCCUGUGGCUCCCACAG |
| hsa-miR-6872 | 3182 | CCCAUGCCUCCUGCCGCGGUC | 3183 | UCUCGCAUCAGGAGGCAAGG |
| hsa-miR-6873 | 3184 | UUCUCUCUGUCUUUCUCUCUCAG | 3185 | CAGAGGGAAUACAGAGGGCAAU |
| hsa-miR-6874 | 3186 | AUGGAGCUGGAACCAGAUCAGGC | 3187 | CAGUUCUGCUGUUCUGACUCUAG |
| hsa-miR-6875 | 3188 | UGAGGGACCCAGGACAGGAGA | 3189 | AUUCUUCCUGCCCUGGCUCCAU |
| hsa-miR-6876 | 3190 | AGCUGUCUGUGUUUUCCUUCUCAG | 3191 | CAGGAAGGACAGGCAGUUCA |
| hsa-miR-6877 | 3192 | CAGCCCUGCCCUUGGCCUCC | 3193 | AGGGCCGAAGGGUGGAAGCUGC |
| hsa-miR-6878 | 3194 | CUGGCCUCUUCUUUCUCCUAG | 3195 | AGGGAGAAAGCUAGAAGCUGAAG |
| hsa-miR-6879 | 3196 | UGUCACCCGCUCCUUGCCCAG | 3197 | CAGGGCAGGGAAGGUGGGAGAG |
| hsa-miR-6880 | 3198 | UGGUGGAGGAAGAGGGCAGCUC | 3199 | CCGCCUUCCUCCUCCCCCAG |
| hsa-miR-6881 | 3200 | AUCCUCUUUCGUCCUUCCCACU | 3201 | UGGGGUAAGGAUAGGAGGGUCA |
| hsa-miR-6882 | 3202 | UGCUGCCUCUCCUCUUGCCUGCAG | 3203 | UACAAGUCAGGAGCUGAAGCAG |
| hsa-miR-6883 | 3204 | UUCCCUAUCUCACUCUCCUCAG | 3205 | AGGGAGGGUGUGGGUAUGGAUGU |
| hsa-miR-6884 | 3206 | CCCAUCACCUUUCCGUCUCCCCU | 3207 | AGAGGCGAGAAGGGUGAUGGUGG |
| hsa-miR-6885 | 3208 | AGGGGGGCACUGCGCAAGCAAAGCC | 3209 | CUUUGCUUCCUGCUCCCCUAG |
| hsa-miR-6886 | 3210 | UGCCCUUCUCUCCUCCUGCCU | 3211 | CCCGCAGGUGAGAUGAGGGCU |
| hsa-miR-6887 | 3212 | UCCCCUCCACUUUCCUCCUAG | 3213 | UGGGGGGACAGAUGGAGAGGACA |
| hsa-miR-6888 | 3214 | AAGGAGAUGCUCAGGCAGAU | 3215 | AUCUGCUCGAUUGUUUCCAG |
| hsa-miR-6889 | 3216 | UCGGGGAGUCUGGGGUCCGGAAU | 3217 | UCUGUGCCCCUACUUCCCAG |
| hsa-miR-6890 | 3218 | CCACUGCCUAUGCCCCACAG | 3219 | CAUGGGUAGGGCAGAGUAGG |
| hsa-miR-6891 | 3220 | CCCUCAUCUUCCCUCCUUUC | 3221 | UAAGGAGGGGAUGAGGGG |
| hsa-miR-6892 | 3222 | GUAAGGGACCGGAGAGUAGGA | 3223 | UCCCUCUCCCACCCCUUGCAG |
| hsa-miR-6893 | 3224 | CCCUGCUGCCUUCACCUGCCAG | 3225 | CAGGCAGGUGUAGGGUGGAGC |
| hsa-miR-6894 | 3226 | UUGCCUGCCCUCUUCCUCCAG | 3227 | AGGAGGAUGGAGAGCUGGGCCAGA |
| hsa-miR-6895 | 3228 | CAGGGCCAGGCACAGAUAAG | 3229 | UGUCUCUCGCCCUUGGCCUUAG |
| hsa-miR-7-1 | 3230 | UGGAAGACUAGUGAUUUUGUUGU | 3231 | CAACAAAUCACAGUCUGCCAUA |
| hsa-miR-7-2 | 3232 | UGGAAGACUAGUGAUUUUGUUGU | 3233 | CAACAAAUCCAGUCUACCUAA |
| hsa-miR-708 | 3234 | CAACUAGACUGUGAGCUUCUAG | 3235 | AAGGAGCUUACAAUCUAGCUGGG |
| hsa-miR-7106 | 3236 | UGGGAGGAGGGGAUCUGGGG | 3237 | AGCUCCCUGAAUCCCUGUCCCAG |
| hsa-miR-7107 | 3238 | UCGGCCUGGGGAGGAGGAAGGG | 3239 | UGGUCUGUUCAUUCUCUCUUUUGGCC |
| hsa-miR-7108 | 3240 | GUGUGGCCGGCAGGCGGUGG | 3241 | ACCCGCCGUCUCCCACAG |
| hsa-miR-7109 | 3242 | CAAGCCUCUCCUGCCCUUCCAG | 3243 | CUGGGGGAGGAGACCCUGCU |
| hsa-miR-711 | 3244 | GGGACCCAGGGAGAGACUAAG | 3245 | UACGUCUCUCCCUGGGUCCCUU |
| hsa-miR-7110 | 3246 | UCUCUCUCCCACUUCCCUGCAG | 3247 | UGGGGGUGUGGGGAGAGAGAG |
| hsa-miR-7111 | 3248 | AUCCUCUCUUCCUCCUCUCAG | 3249 | UGGGGGAGGAAGGACAGGCCAU |
| hsa-miR-7112 | 3250 | UGCAUCACAGCCUUUGCCCUAG | 3251 | ACGGGCAGGGCAGUGCACCCUG |
| hsa-miR-7113 | 3252 | UCCAGGGAGACAGUGUGUGAG | 3253 | CCUCCCUGCCCGCCUCUCUGCAG |
| hsa-miR-7114 | 3254 | UGACCCACCCCUCUCCACCAG | 3255 | UCUGUGGAGUGGGGUGCCUGU |
| hsa-miR-7150 | 3256 | CUGGCAGGGGGAGAGGUA | 3257 | CCUCUCCCCUGCCAGUU |
| hsa-miR-7151 | 3258 | GAUCCAUCUCUGCCUGUAUUGGC | 3259 | CUACAGGCUGGAAUGGGCUCA |

TABLE 1-continued miRNA Sequences

| miRNA | SEQ ID NO | Sequence 1 | SEQ ID NO | Sequence 2 |
|---|---|---|---|---|
| hsa-miR-7152 | 3260 | UCUGGUCCUGGACAGGAGGC | 3261 | UUUCCUGUCCUCCAACCAGACC |
| hsa-miR-7153 | 3262 | CACCAUGGACGGUUUACC | 3263 | UGAGAACUGACAAAUGUGGUAGG |
| hsa-miR-7154 | 3264 | UUCAUGAACUGGGUCUAGCUUGG | 3265 | AGGAGGACAAGUUGUGGGAU |
| hsa-miR-7155 | 3266 | UGGCCCAAGACCUCAGACC | 3267 | UCUGGGGUCUUGGGCCAUC |
| hsa-miR-7156 | 3268 | CUGCAGCCACUUGGGGAACUGGU | 3269 | UUGUUCUCAAACUGGCUGUCAGA |
| hsa-miR-7157 | 3270 | UCUGUGCUACUGGAUGAAGAGU | 3271 | UCAGCAUUCAUUGGCACCAGAGA |
| hsa-miR-7158 | 3272 | GGCUCAAUCUCUGGUCCUGCAGCC | 3273 | CUGAACUAGAGAUUGGGCCCA |
| hsa-miR-7159 | 3274 | UUUCUAUGUUAGUUGGAAG | 3275 | UUCAACAAGGGUGUAGGAUGG |
| hsa-miR-7160 | 3276 | CAGGGCCCUGGCUUUAGCAGA | 3277 | UGCUGAGGUCCGGGCUGUGCC |
| hsa-miR-7161 | 3278 | UAAAGACUGUAGAGGCAACUGGU | 3279 | UAGAUCUUUGACUCUGGCAGUCUCCAGG |
| hsa-miR-7162 | 3280 | UCUGAGGUGGAACAGCAGC | 3281 | UGCUUCCUUUCUCAGCUG |
| hsa-miR-718 | 3282 | CUUCCGCCCCGCCGGGCGUCG | 3283 | ACGCCCGGCGGGGCGGAAGUU |
| hsa-miR-744 | 3284 | UGCGGGGCUAGGGCUAACAGCA | 3285 | CUGUUGCCACUAACCUCAACCU |
| hsa-miR-7515 | 3286 | AGAAGGGAAGAUGGUGAC | 3287 | CACCAUCUUCCCUUCUUU |
| hsa-miR-758 | 3288 | UUUGUGACCUGGUCCACUAACC | 3289 | GAUGGUUGACCAGAGAGCACAC |
| hsa-miR-759 | 3290 | GCAGAGUGCAAACAAUUUUGAC | 3291 | CAAAAUUGUUUGCACUCUGCUU |
| hsa-miR-760 | 3292 | CGGCUCUGGGUCUGUGGGGA | 3293 | CCCACAGACCCAGAGCCGUU |
| hsa-miR-761 | 3294 | GCAGCAGGGUGAAACUGACACA | 3295 | UGUCAGUUUCACCCUGCUGCUU |
| hsa-miR-762 | 3296 | GGGGCUGGGGCCGGGGCCGAGC | 3297 | UCGGCCCCGGCCCCAGCCCCUU |
| hsa-miR-764 | 3298 | GCAGGUGCUCACUUGUCCUCCU | 3299 | GAGGACAAGUGAGCACCUGCUU |
| hsa-miR-7641 | 3300 | UUGAUCUCGGAAGCUAAGC | 3301 | UUAGCUUCCGAGAUCAAUU |
| hsa-miR-765 | 3302 | UGGAGGAGAAGGAAGGUGAUG | 3303 | UCACCUUCCUUCUCCUCCAUU |
| hsa-miR-766 | 3304 | AGGAGGAAUUGGUGCUGGUCUU | 3305 | ACUCCAGCCCCACAGCCUCAGC |
| hsa-miR-767 | 3306 | UGCACCAUGGUUGUCUGAGCAUG | 3307 | UCUGCACAACCCCAUGGUUUCU |
| hsa-miR-769 | 3308 | CUGGAUCUCCGGGUCUUGGUU | 3309 | UGAGACCUCUGGGUUCUGAGCU |
| hsa-miR-770 | 3310 | UCCAGUACCACGUGUCAGGGCCA | 3311 | GCCCUGACACGUGGUACUGGAUU |
| hsa-miR-7702 | 3312 | CUUAGACUGCCAGACUCCCUGA | 3313 | AGGGAGUCUGGCAGUCUAAGUU |
| hsa-miR-7703 | 3314 | UUGCACUCUGGCCUUCUCCCAGG | 3315 | UGGGAAAGGCCAGAGUGCAAUU |
| hsa-miR-7704 | 3316 | CGGGGUCGGCGGCGACGUG | 3317 | CGUCGCCGCCGACCCCGUU |
| hsa-miR-7705 | 3318 | AAUAGCUCAGAUGUCAGUUCUG | 3319 | GAACUGACAUUCUGAGCUAUUU |
| hsa-miR-7706 | 3320 | UGAAGCGCCUGUGCUCUGCCGAGA | 3321 | UCGGCAGAGCACAGGCGCUUCAUU |
| hsa-miR-7843 | 3322 | AUGAAGCCUUCUCUGCCUUACG | 3323 | GAGGGCAGAGCCAGCUUCCUGA |
| hsa-miR-7844 | 3324 | AAAACUAGGACUGUGUGGUGUA | 3325 | CACCACACAGUCCUAGUUUUU |
| hsa-miR-7845 | 3326 | AAGGGACAGGGAGGGUCGUGG | 3327 | ACGACCCUCCCUGUCCCUUUU |
| hsa-miR-7846 | 3328 | CAGCGGAGCCUGGAGAGAAGG | 3329 | UUCUCUCCAGGCUCCGCUGUU |
| hsa-miR-7847 | 3330 | CGUGGAGGACGAGGAGGAGGC | 3331 | CUCCUCCUCGUCCUCCACGUU |
| hsa-miR-7848 | 3332 | CUACCCUCGGUCUGCUUACCACA | 3333 | UGGUAAGCAGACCGAGGGUAGUU |
| hsa-miR-7849 | 3334 | GACAAUUGUUGAUCUUGGGCCU | 3335 | GCCCAAGAUCAACAAUUGUCUU |
| hsa-miR-7850 | 3336 | GUUUGGACAUAGUGUGGCUGG | 3337 | AGCCACACUAUGUCCAAACUU |
| hsa-miR-7851 | 3338 | UACCUGGGAGACUGAGGUUGGA | 3339 | CAACCUCAGUCUCCCAGGUAUU |
| hsa-miR-7852 | 3340 | UAUGUAGUAGUCAAAGGCAUUU | 3341 | AUGCCUUUGACUACUACAUAUU |
| hsa-miR-7853 | 3342 | UCAAAUGCAGAUCCUGACUUC | 3343 | AGUCAGGAUCUGCAUUUGAUU |
| hsa-miR-7854 | 3344 | UGAGGUGACCGCAGAUGGGAA | 3345 | CCCAUCUGCGGUCACCUCAUU |
| hsa-miR-7855 | 3346 | UUGGUGAGGACCCCAAGCUCGG | 3347 | GAGCUUGGGGUCCUCACCAAUU |
| hsa-miR-7856 | 3348 | UUUUAAGGACACUGAGGGAUC | 3349 | UCCCCACAGUGUCCUUAAAAUU |
| hsa-miR-7973 | 3350 | UGUGACCCUAGAAUAAUUAC | 3351 | AAUUAUUCUAGGGUCACAUU |
| hsa-miR-7974 | 3352 | AGGCUGUGAUGCUCUCCUGAGCCC | 3353 | GCUCAGGAGAGCAUCACAGCCUUU |
| hsa-miR-7975 | 3354 | AUCCUAGUCACGGCACCA | 3355 | GUGCCGUGACUAGGAUUU |
| hsa-miR-7976 | 3356 | UGCCCUGAGACUUUUGCUC | 3357 | GCAAAAGUCUCAGGGCAUU |
| hsa-miR-7977 | 3358 | UUCCCAGCCAACGCACCA | 3359 | GUGCGUUGCUCGGGAAUU |
| hsa-miR-7978 | 3360 | UCUGGUGUAUAGCGUUGCUCA | 3361 | AGCAACGCUAUACACCAGAUU |
| hsa-miR-802 | 3362 | CAGUAACAAAGAUUCAUCCUUGU | 3363 | AAGGAUGAAUCUUUGUUACUGUU |
| hsa-miR-8052 | 3364 | CGGGACUGUAGAGGGCAUGAGC | 3365 | UCAUGCCCUCUACAGUCCCGUU |
| hsa-miR-8053 | 3366 | UGGCGAUUUUGGAACUCAAUGGCA | 3367 | CCAUUGAGUUCCAAAAUCGCCAUU |
| hsa-miR-8054 | 3368 | GAAAGUACAGAUCGGAUGGGU | 3369 | CCAUCCGAUCUGUACUUUCUU |
| hsa-miR-8055 | 3370 | CUUUGAGCACAUGAGCAGACGGA | 3371 | CGUCUGCUCAUGUGCUCAAAGUU |
| hsa-miR-8056 | 3372 | CGUGGAUUGUCUGGAUGCAU | 3373 | GCAUCCAGACAAUCCACGUU |
| hsa-miR-8057 | 3374 | GUGGCUCUGUAGUAAGAUGGA | 3375 | CAUCUUACUACAGAGCCACUU |
| hsa-miR-8058 | 3376 | CUGGACUUUGAUCUUGCCAUAA | 3377 | AUGGCAAGAUCAAAGUCCAGUU |
| hsa-miR-8059 | 3378 | GGGGAACUGUAGAUGAAAGGC | 3379 | CUUUUCAUCUACAGUUCCCCUU |
| hsa-miR-8060 | 3380 | CCAUGAAGCAGUGGGUAGGAGGAC | 3381 | CCUCCUACCCACUGCUUCAUGGUU |
| hsa-miR-8061 | 3382 | CUUAGAUUAGAGGAUAUUGUU | 3383 | CAAUAUCCUCUAAUCUAAGUU |
| hsa-miR-8062 | 3384 | CAGUGAUUUGAGGAUUAUUGC | 3385 | AAUAAUCCUCAAAUCACUGUU |
| hsa-miR-8063 | 3386 | UCAAAAUCAGGAGUCGGGCUU | 3387 | GCCCCGACUCCUGAUUUUGAUU |
| hsa-miR-8064 | 3388 | AGCACACUGAGCGAGCGGAC | 3389 | CCGCUCGCUCAGUGUGCUUU |
| hsa-miR-8065 | 3390 | UGUAGGAACAGUUGAAUUUUGGCU | 3391 | CCAAAAUUCAACUGUUCCUACAUU |
| hsa-miR-8066 | 3392 | CAAUGUGAUCUUUUGGAUGUA | 3391 | CAUCCAAAAGAUCACAUUGUU |
| hsa-miR-8067 | 3394 | CCUAGAAACUGUAAACUUAGUC | 3395 | CUAAGUUUACAGUUUCUAGGUU |
| hsa-miR-8068 | 3396 | UGUUUGUUGUAAGGAUCGUUGU | 3397 | AACGAUCCUUACAACAAACAUU |
| hsa-miR-8069 | 3398 | GAUGGUUGGGGCGGUCGGCGU | 3399 | GCCGACCGCCCCAACCAUCCUU |
| hsa-miR-8070 | 3400 | AUGUGAUUGACGGCUGACUCCA | 3401 | GAGUCAGCCGUCAAUCACAUUU |
| hsa-miR-8071 | 3402 | CGGUGGACUGGAGUGGGUGG | 3403 | ACCCACUCCAGUCCACCGUU |
| hsa-miR-8072 | 3404 | GGCGGCGGGGAGGUAGGCAG | 3405 | GCCUACCUCCCCGCCGCCUU |
| hsa-miR-8073 | 3406 | ACCUGGCAGCAGGGAGCGUCGU | 3407 | GACGCUCCCUGCUGCCAGGUUU |
| hsa-miR-8074 | 3408 | CUAUGGCGAGACUGGCAUGUACUC | 3409 | GUACAUGCCAGUCUCGCCAUAGUU |

TABLE 1-continued miRNA Sequences

| miRNA | SEQ ID NO | Sequence 1 | SEQ ID NO | Sequence 2 |
|---|---|---|---|---|
| hsa-miR-8075 | 3410 | UGCUGAUGGCAGAUGUCGGGUCUG | 3411 | GACCCGACAUCUGCCAUCAGCAUU |
| hsa-miR-8076 | 3412 | UAUAUGGACUUUUCUGAUACAAUG | 3413 | UUGUAUCAGAAAAGUCCAUAUAUU |
| hsa-miR-8077 | 3414 | GGCUGAGUGGGGUUCUGACUCC | 3415 | AGUCAGAACCCCACUCAGCCUU |
| hsa-miR-8078 | 3416 | GGUCUAGGCCCGGUGAGAGACUC | 3417 | GUCUCUCACCGGGCCUAGACCUU |
| hsa-miR-8079 | 3418 | CAGUGAUCGUCUCUGCUGGC | 3419 | CAGCAGAGACGAUCACUGUU |
| hsa-miR-8080 | 3420 | GAAGGACACUGGUGUCAACGGCU | 3421 | CCGUUGACACCAGUGUCCUUCUU |
| hsa-miR-8081 | 3422 | CUUGAGUCGUGCCUUUCUGAAUG | 3423 | UUCAGAAAGGCACGACUCAAGUU |
| hsa-miR-8082 | 3424 | UGAUGGAGCUGGGAAUACUCUG | 3425 | GAGUAUUCCCAGCUCCAUCAUU |
| hsa-miR-8083 | 3426 | CAGGACUUGACGGCUGCAACU | 3427 | UUGCAGCCGUCAAGUCCUGUU |
| hsa-miR-8084 | 3428 | GAAUACUAAGUAAAAAAUCAGUA | 3429 | CUGAUUUUUACUUAGUAUUCUU |
| hsa-miR-8085 | 3430 | UGGGAGAGAGGACUGUGAGGC | 3431 | CUCACAGUCCUCUCUCCCAUU |
| hsa-miR-8086 | 3432 | UGCUAGUCUGGACUGAUAUGGU | 3433 | CAUAUCAGUCCAGACUAGCAUU |
| hsa-miR-8087 | 3434 | GAAGACUUCUUGGAUUACAGGGG | 3435 | CCUGUAAUCCAAGAAGUCUUCUU |
| hsa-miR-8088 | 3436 | CCUCGGUACUGGAAAGGGGUA | 3437 | CCCCUUUCCAGUACCGAGGUU |
| hsa-miR-8089 | 3438 | CCUGGGGACAGGGGAUUGGGGCAG | 3439 | GCCCCAAUCCCCUGUCCCCAGGUU |
| hsa-miR-8485 | 3440 | CACACACACACACACGUAU | 3441 | ACGUGUGUGUGUGUGUGUGUU |
| hsa-miR-873 | 3442 | GCAGGAACUUGUGAGUCUCCU | 3443 | GGAGACUGAUGAGUUCCCGGGA |
| hsa-miR-874 | 3444 | CGGCCCCACGCACCAGGGUAAGA | 3445 | CUGCCCUGGCCCGAGGGACCGA |
| hsa-miR-875 | 3446 | UAUACCUCAGUUUUAUCAGGUG | 3447 | CCUGGAAACACUGAGGUUGUG |
| hsa-miR-876 | 3448 | UGGAUUUCUUUGUGAAUCACCA | 3449 | UGGUGGUUUACAAAGUAAUUCA |
| hsa-miR-877 | 3450 | UCCUCUUCUCCCUCCUCCCAG | 3451 | GUAGAGGAGAUGGCGCAGGG |
| hsa-miR-885 | 3452 | UCCAUUACACUACCCUGCCUCU | 3453 | AGGCAGCGGGGUGUAGUGGAUA |
| hsa-miR-887 | 3454 | CUUGGGAGCCCUGUUAGACUC | 3455 | GUGAACGGGCGCCAUCCCGAGG |
| hsa-miR-888 | 3456 | UACUCAAAAAGCUGUCAGUCA | 3457 | GACUGACACCUCUUUGGGUGAA |
| hsa-miR-889 | 3458 | AAUGGCUGUCCGUAGUAUGGUC | 3459 | UUAAUAUCGGACAACCAUUGU |
| hsa-miR-890 | 3460 | UACUUGGAAAGGCAUCAGUUG | 3461 | ACUGAUGCCUUUCCAAGUAUU |
| hsa-miR-891a | 3462 | AGUGGCACAUGUUUGUUGUGAG | 3463 | UGCAACGAACCUGAGCCACUGA |
| hsa-miR-891b | 3464 | UGCAACUUACCUGAGUCAUUGA | 3465 | AAUGACUCAGGUAAGUUGCAUU |
| hsa-miR-892a | 3466 | CACUGUGUCCUUUCUGCGUAG | 3467 | ACGCAGAAAGGACACAGUGUU |
| hsa-miR-892b | 3468 | CACUGGCUCCUUUCUGGGUAGA | 3469 | UACCCAGAAAGGAGCCAGUGUU |
| hsa-miR-892c | 3470 | CACUGUUUCCUUUCUGAGUGGA | 3471 | UAUUCAGAAAGGUGCCAGUCA |
| hsa-miR-9 | 3472 | UCUUUGGUUAUCUAGCUGUAUGA | 3473 | AUAAAGCUAGAUAACCGAAAGU |
| hsa-miR-920 | 3474 | GGGGAGCUGUGGAAGCAGUA | 3475 | CUGCUUCCACAGCUCCCCUU |
| hsa-miR-921 | 3476 | CUAGUGAGGGACAGAACCAGGAUUC | 3477 | AUCCUGGUUCUGUCCCUCACUAGUU |
| hsa-miR-922 | 3478 | GCAGCAGAGAAUAGGACUACGUC | 3479 | CGUAGUCCUAUUCUCUGCUGCUU |
| hsa-miR-924 | 3480 | AGAGUCUUGUGAUGUCUUGC | 3481 | AAGACAUCACAAGACUCUUU |
| hsa-miR-92a-1 | 3482 | UAUUGCACUUGUCCCGGCCUGU | 3483 | AGGUUGGGAUCGGUUGCAAUGCU |
| hsa-miR-92a-2 | 3484 | UAUUGCACUUGUCCCGGCCUGU | 3485 | GGGUGGGGAUUUGUUGCAUUAC |
| hsa-miR-92b | 3486 | UAUUGCACUCGUCCCGGCCUCC | 3487 | AGGGACGGGACGCGGUGCAGUG |
| hsa-miR-93 | 3488 | ACUGCUGAGCUAGCACUUCCCG | 3489 | CAAAGUGCUGUUCGUGCAGGUAG |
| hsa-miR-933 | 3490 | UGUGCGCAGGGAGACCUCUCCC | 3491 | GAGAGGUCUCCCUGCGCACAUU |
| hsa-miR-934 | 3492 | UGUCUACUACUGGAGACACUGG | 3493 | AGUGUCUCCAGUAGUAGACAUU |
| hsa-miR-935 | 3494 | CCAGUUACCGCUUCCGCUACCGC | 3495 | GGUAGCGGAAGCGGUAACUGGUU |
| hsa-miR-936 | 3496 | ACAGUAGAGGGAGGAAUCGCAG | 3497 | GCGAUUCCUCCCCUCUACUGUUU |
| hsa-miR-937 | 3498 | AUCCGCGCUCUGACUCUCUGCC | 3499 | GUGAGUCAGGGUGGGCUGG |
| hsa-miR-938 | 3500 | UGCCCUUAAAGGUGAACCCAGU | 3501 | UGGGUUCACCUUUAAGGGCAUU |
| hsa-miR-939 | 3502 | CCCUGGGGCCUCUGCUCCCCAG | 3503 | UGGGGAGCUGAGGCUCUGGGGGUG |
| hsa-miR-940 | 3504 | AAGGCAGGGCCCCCGCUCCCC | 3505 | GGAGCGGGGCCCUGCCUUUU |
| hsa-miR-941 | 3506 | CACCCGGCUGUGUGCACAUGUGC | 3507 | ACAUGUGCACAGCCGGGUGUU |
| hsa-miR-942 | 3508 | UCUUCUCUGUUUUGGCCAUGUG | 3509 | CACAUGGCCGAAACAGAGAAGU |
| hsa-miR-943 | 3510 | CUGACUGUUGCCGUCCUCCAG | 3511 | GGAGGACGGCAACAGUCAGUU |
| hsa-miR-944 | 3512 | AAAUUAUUGUACAUCGGAUGAG | 3513 | CAUCCGAUGUACAAUAAUUUUU |
| hsa-miR-95 | 3514 | UCAAUAAAUGUCUGUUGAAUU | 3515 | UUCAACGGGUAUUUAUUGACA |
| hsa-miR-9500 | 3516 | AAGGGAAGAUGGUGACCAC | 3517 | GGUCACCAUCUUCCCUUUU |
| hsa-miR-96 | 3518 | UUUGGCACUAGCACAUUUUUGCU | 3519 | AAUCAUGUGCAGUGCCAAUAUG |
| hsa-miR-98 | 3520 | CUAUACAACUUACUACUUUCCC | 3521 | UGAGGUAGUAAGUUGUAUUGUU |
| hsa-miR-99a | 3522 | CAAGCUCGCUUCUAUGGGUCUG | 3523 | AACCCGUAGAUCCGAUCUUGUG |
| hsa-miR-99b | 3524 | CACCCGUAGAACCGACCUUGCG | 3525 | CAAGCUCGUGUCUGUGGGUCCG |

Example 2: Measurement of Activity of miRNA Library Sample

In order to determine whether the double-stranded miR-NAs synthesized in Example 1 would be active, miR-34a, miR-100 and miR-125b were selected from the consisting of about 1700 kinds of miRNAs. The selected miRNAs were selected because there are many studies on target mRNAs whose functions and expressions are to be controlled and on regions binding to mRNA 3'UTR. The 3' UTR region of each of Bcl2, mTOR and Lin28b mRNA, expressions of which are known to be controlled by each of miR-34a, miR-100 and miR-125b, was substituted into the 3' UTR of a firefly luciferase vector, thereby constructing a vector corresponding to each of the miRNAs. Each vector and an miR control, or miR-34a, miR-100 or miR-125b corresponding to each vector, were co-transfected into HEK-293T cells by use of Lipofectamine 2000 (Lipofectamine 2000, Invitrogen) which is an intracellular oligo delivery reagent (preparation of triplicate samples), and the cells were cultured under the conditions of 37° C. and 5% (v/v) $CO_2$ for 24 hours. Luciferase activity was measured by a luminometer (Thermo scientific) to determine the activities of the synthesized miRNAs (FIG. 1).

Figure 2:
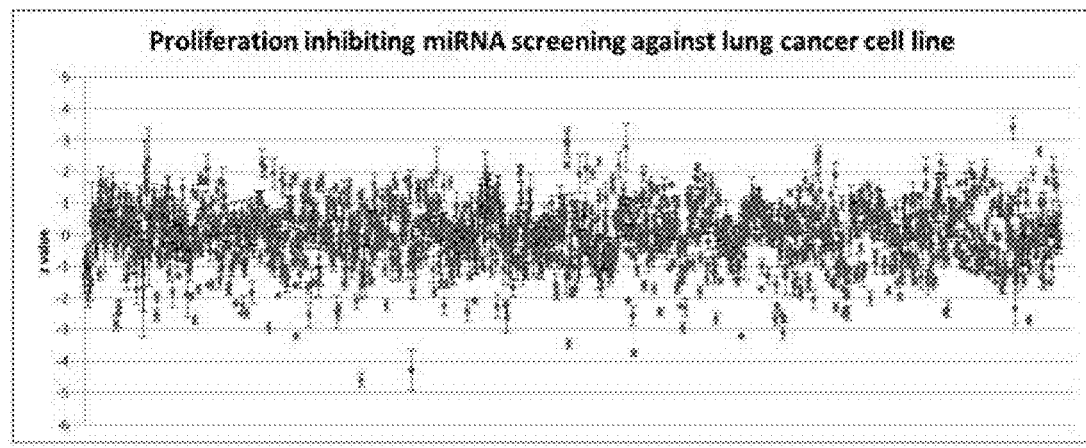
FIG. 2 shows the results obtained by treating lung cancer NCI-H460 cells with a screening library consisting of about 1700 kinds of miRNAs, quantifying the growth of the cells using Resazurin reagent, and expressing the quantification results as relative growth values.

Example 3: Screening for Identification of microRNAs that Inhibit Proliferation of Lung Cancer Cells 3,000~40,000 NCI-H460 cells were dispensed in each well of 96-well plates and cultured under the conditions of 37° C. and 5% (v/v) $CO_2$ for 24 hours, and then each of the miRNAs selected from the miRNA library was transfected into the cells to a final concentration of 100 nM by use of RNAiMAX reagent (Invitrogen). Since each miRNA was transfected three times, three 96-well plates were prepared per each miRNA. The cells were further cultured under the same conditions as described above for 24 hours, and then the fluorescence value generated by addition of Resazurin reagent (Promega) was measured using a fluorometer (Tecan). To comparatively evaluate the cell growth inhibitory abilities of the miRNAs, the mean value and standard deviation of the 96 values measured for the 96-well plate were calculated, and the standard deviation multiple (Z-score) of the value measured for each well (containing each miRNA) from the mean value was calculated using the following equation:

$$z_i = \frac{x_i - \mu}{\sigma}$$

wherein $x_i$ is the value measured in each well, $\mu$ is the mean value of the values measured for all the wells of the plate, and $\sigma$ is standard deviation. The standard deviation multiple $z_i$ of each well was the mean value of the values obtained for the triplicate plates, and about first candidate miRNAs showing a $z_i$ value smaller than −2 were selected (FIG. 2 and Table 2).

TABLE 2

First Selected miRNA Sequences

| | | | |
|---|---|---|---|
| SEQ ID NO: 1 | hsa-miR-23c | Strand 1 | AUCACAUUGCCAGUGAUUACCC |
| SEQ ID NO: 2 | hsa-miR-23c | Strand 2 | GUAAUCACUGGCAAUGUGAUUU |
| SEQ ID NO: 3 | hsa-miR-219b | Strand 1 | AGAUGUCCAGCCACAAUUCUCG |
| SEQ ID NO: 4 | hsa-miR-219b | Strand 2 | AGAAUUGCGUUUGGACAAUCAGU |
| SEQ ID NO: 5 | hsa-miR-378c | Strand 1 | ACUGGACUUGGAGUCAGAAGAGUGG |
| SEQ ID NO: 6 | hsa-miR-378c | Strand 2 | ACUCUUCUGACUCCAAGUCCAGUUU |
| SEQ ID NO: 7 | hsa-miR-548aa | Strand 1 | AAAAACCACAAUUACUUUUGCACCA |
| SEQ ID NO: 8 | hsa-miR-548aa | Strand 2 | GUGCAAAAGUAAUUGUGGUUUUUUU |
| SEQ ID NO: 9 | hsa-miR-548u | Strand 1 | CAAAGACUGCAAUUACUUUUGCG |
| SEQ ID NO: 10 | hsa-miR-548u | Strand 2 | CAAAAGUAAUUGCAGUCUUUGUU |
| SEQ ID NO: 11 | hsa-miR-571 | Strand 1 | UGAGUUGGCCAUCUGAGUGAG |
| SEQ ID NO: 12 | hsa-miR-571 | Strand 2 | CACUCAGAUGGCCAACUCAUU |
| SEQ ID NO: 13 | hsa-miR-641 | Strand 1 | AAAGACAUAGGAUAGAGUCACCUC |
| SEQ ID NO: 14 | hsa-miR-641 | Strand 2 | GGUGACUCUAUCCUAUGUCUUUUU |
| SEQ ID NO: 15 | hsa-miR-1244 | Strand 1 | AAGUAGUUGGUUUGUAUGAGAUGGUU |
| SEQ ID NO: 16 | hsa-miR-1244 | Strand 2 | CCAUCUCAUACAAACCAACUACUUUU |
| SEQ ID NO: 17 | hsa-miR-1248 | Strand 1 | ACCUUCUUGUAUAAGCACUGUGCUAAA |
| SEQ ID NO: 18 | hsa-miR-1248 | Strand 2 | UAGCACAGUGCUUUAUACAAGAAGGUUU |
| SEQ ID NO: 19 | hsa-miR-1298 | Strand 1 | CAUCUGGGCAACUGACUGAAC |
| SEQ ID NO: 20 | hsa-miR-1298 | Strand 2 | UUCAUUCGGCUGUCCAGAUGUA |
| SEQ ID NO: 21 | hsa-miR-2392 | Strand 1 | UAGGAUGGGGGUGAGAGGUG |
| SEQ ID NO: 22 | hsa-miR-2392 | Strand 2 | CCUCUCACCCCCAUCCUAUU |
| SEQ ID NO: 23 | hsa-miR-3119 | Strand 1 | UGGCUUUUAACUUUGAUGGC |
| SEQ ID NO: 24 | hsa-miR-3119 | Strand 2 | CAUCAAAGUUAAAAGCCAUU |
| SEQ ID NO: 25 | hsa-miR-3164 | Strand 1 | UGUGACUUUAAGGGAAAUGGCG |
| SEQ ID NO: 26 | hsa-miR-3164 | Strand 2 | CCAUUUCCCUUAAAGUCACAUU |
| SEQ ID NO: 27 | hsa-miR-3188 | Strand 1 | AGAGGCUUUGUGCGGAUACGGGG |
| SEQ ID NO: 28 | hsa-miR-3188 | Strand 2 | CCGUAUCCGCACAAAGCCUCUUU |

TABLE 2-continued

First Selected miRNA Sequences

| | | | |
|---|---|---|---|
| SEQ ID NO: 29 | hsa-miR-3609 | Strand 1 | CAAAGUGAUGAGUAAUACUGGCUG |
| SEQ ID NO: 30 | hsa-miR-3609 | Strand 2 | GCCAGUAUUACUCAUCACUUUGUU |
| SEQ ID NO: 31 | hsa-miR-3612 | Strand 1 | AGGAGGCAUCUUGAGAAAUGGA |
| SEQ ID NO: 32 | hsa-miR-3612 | Strand 2 | CAUUUCUCAAGAUGCCUCCUUU |
| SEQ ID NO: 33 | hsa-miR-3662 | Strand 1 | GAAAAUGAUGAGUAGUGACUGAUG |
| SEQ ID NO: 34 | hsa-miR-3662 | Strand 2 | UCAGUCACUACUCAUCAUUUUCUU |
| SEQ ID NO: 35 | hsa-miR-3670 | Strand 1 | AGAGCUCACAGCUGUCCUUCUCUA |
| SEQ ID NO: 36 | hsa-miR-3670 | Strand 2 | GAGAAGGACAGCUGUGAGCUCUUU |
| SEQ ID NO: 37 | hsa-miR-3943 | Strand 1 | UAGCCCCCAGGCUUCACUUGGCG |
| SEQ ID NO: 38 | hsa-miR-3943 | Strand 2 | CCAAGUGAAGCCUGGGGGCUAUU |
| SEQ ID NO: 39 | hsa-miR-4424 | Strand 1 | AGAGUUAACUCAAAAUGGACUA |
| SEQ ID NO: 40 | hsa-miR-4424 | Strand 2 | GUCCAUUUUGAGUUAACUCUUU |
| SEQ ID NO: 41 | hsa-miR-4461 | Strand 1 | GAUUGAGACUAGUAGGGCUAGGC |
| SEQ ID NO: 42 | hsa-miR-4461 | Strand 2 | CUAGCCCUACUAGUCUCAAUCUU |
| SEQ ID NO: 43 | hsa-miR-4477a | Strand 1 | CUAUUAAGGACAUUUGUGAUUC |
| SEQ ID NO: 44 | hsa-miR-4477a | Strand 2 | AUCACAAAUGUCCUUAAUAGUU |
| SEQ ID NO: 45 | hsa-miR-4477b | Strand 1 | AUUAAGGACAUUUGUGAUUGAU |
| SEQ ID NO: 46 | hsa-miR-4477b | Strand 2 | CAAUCACAAAUGUCCUUAAUUU |
| SEQ ID NO: 47 | hsa-miR-4765 | Strand 1 | UGAGUGAUUGAUAGCUAUGUUC |
| SEQ ID NO: 48 | hsa-miR-4765 | Strand 2 | ACAUAGCUAUCAAUCACUCAUU |
| SEQ ID NO: 49 | hsa-miR-4773 | Strand 1 | CAGAACAGGAGCAUAGAAAGGC |
| SEQ ID NO: 50 | hsa-miR-4773 | Strand 2 | CUUUCUAUGCUCCUGUUCUGUU |
| SEQ ID NO: 51 | hsa-miR-4776 | Strand 1 | GUGGACCAGGAUGGCAAGGGCU |
| SEQ ID NO: 52 | hsa-miR-4776 | Strand 2 | CUUGCCAUCCUGGUCCACUGCAU |
| SEQ ID NO: 53 | hsa-miR-4999 | Strand 1 | UGCUGUAUUGUCAGGUAGUGA |
| SEQ ID NO: 54 | hsa-miR-4999 | Strand 2 | UCACUACCUGACAAUACAGU |
| SEQ ID NO: 55 | hsa-miR-5096 | Strand 1 | GUUUCACCAUGUUGGUCAGGC |
| SEQ ID NO: 56 | hsa-miR-5096 | Strand 2 | CUGACCAACAUGGUGAAACUU |
| SEQ ID NO: 57 | hsa-miR-5697 | Strand 1 | UCAAGUAGUUUCAUGAUAAAGG |
| SEQ ID NO: 58 | hsa-miR-5697 | Strand 2 | UUUAUCAUGAAACUACUUGAUU |
| SEQ ID NO: 59 | hsa-miR-5705 | Strand 1 | UGUUUCGGGCUCAUGGCCUGUG |
| SEQ ID NO: 60 | hsa-miR-5705 | Strand 2 | CAGGCCAUGAGCCCCGAAACAUU |
| SEQ ID NO: 61 | hsa-miR-5707 | Strand 1 | ACGUUUGAAUGCUGUACAAGGC |
| SEQ ID NO: 62 | hsa-miR-5707 | Strand 2 | CUUGUACAGCAUUCAAACGUUU |
| SEQ ID NO: 63 | hsa-miR-8053 | Strand 1 | UGGCGAUUUUGGAACUCAAUGGCA |
| SEQ ID NO: 64 | hsa-miR-8053 | Strand 2 | CCAUUGAGUUCCAAAAUCGCCAUU |
| SEQ ID NO: 65 | hsa-miR-8078 | Strand 1 | GGUCUAGGCCCGGUGAGAGACUC |
| SEQ ID NO: 66 | hsa-miR-8078 | Strand 2 | GUCUCUCACCGGGCCUAGACCUU |

Figure 3:
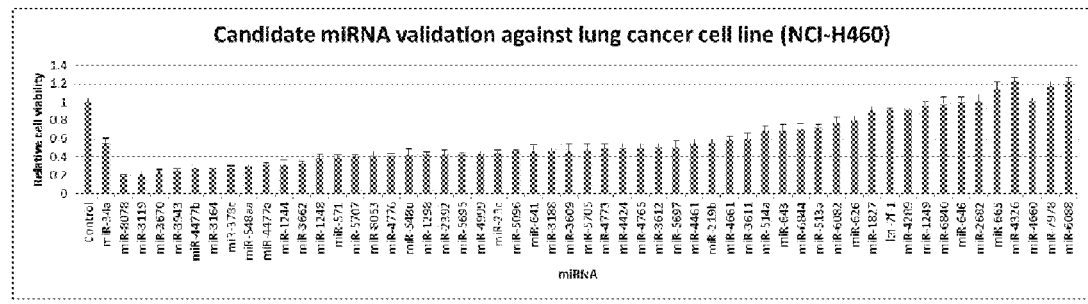
FIG. 3 shows the results obtained by selecting about 50 kinds of miRNAs showing excellent efficacy in the NCI-H460 cell line, and measuring the relative cancer cell growth inhibitory abilities of the selected miRNAs using WST-1 reagent.

Example 4: Second Screening for Identification of miRNAs that Inhibit Proliferation of Lung Cancer Cells Using about 50 miRNA candidates obtained in first screening, second screening was performed with increased measurement precision. The experiment was performed under the same conditions as first screening, except that WST-1 reagent (Roche) was used instead of the Resazurin reagent to measure the proliferation potential of the cells. WST-1 has an advantage over Resazurin in that the intensity of signals can be more quantitatively measured. The values obtained by measuring the cell proliferation inhibitory ability of each miRNA were expressed as values relative to the control, and the results are shown in FIG. 3. As a positive control, miR-34a was used.

Example 5: Analysis of the Ability to Induce Cell Apoptosis

Figure 4:
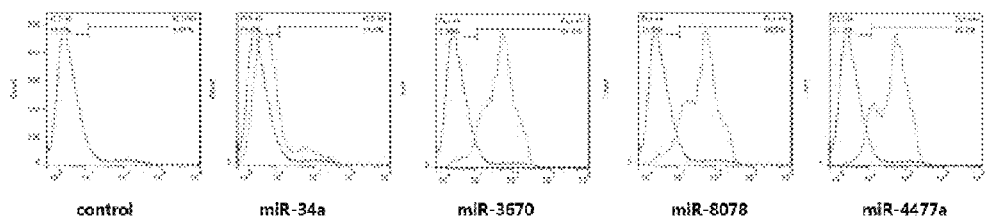
FIG. 4 shows the results obtained by transfecting each of miR-34a, miR-3670, miR-8078 and miR-4477a into a lung cancer cell line, staining the cells with FITC-labeled Annexin V, and analyzing the stained cells by flow cytometry to determine the apoptotic effect of the miRNAs on the lung cancer cell line.

The method used in screening is a method of measuring the relative inhibition of cell proliferation by quantitatively measuring the number of cells. Mechanisms by which cell proliferation is inhibited include a method of reducing cell division rate, and a method of inducing apoptosis. In order to analyze the mechanism by which the miRNAs found in the present invention inhibit cell proliferation, the degree of apoptosis was analyzed using the Fluorescence Activated Cell Sorter (FACS). Specifically, cells were dispensed in 6-well plates, and the miRNA was transfected into the cells by use of RNAiMAX reagent, and then the cells were cultured under the same conditions as described above for 48 hours. Next, the cells treated with FITC-labeled Annexin V and analyzed using the Fluorescence Activated Cell Sorter (FACS) (FIG. 4). The results of the analysis indicated that the cells treated with each of miR-3670, miR-4477a and miR-8078 were mostly dead. This suggests that the tumor cell growth inhibitory effect of the miRNA identified in screening resulted from induction of apoptosis (Table 3).

Example 6: Inhibition of Tumor Cell Growth on Soft Agar by miRNAs

Figure 5:
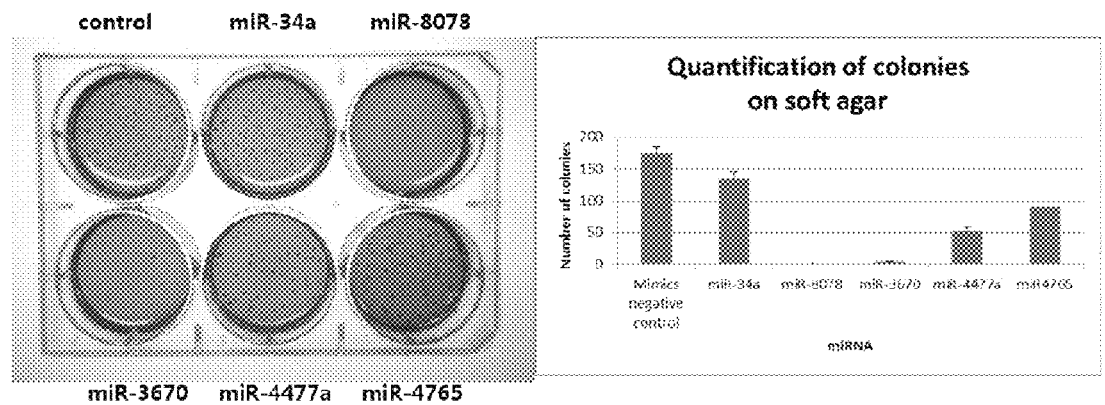
FIG. 5 shows the results obtained by transfecting each miRNA into a lung cancer cell line, culturing the cells on soft agar for 2 weeks, and measuring the effects of the miRNAs against the colony-forming ability of the lung cancer cell line.

When tumor cells were cultured using soft agar, the characteristic of tumor cells can be measured. Normal cells require a support such as a culture dish for growth, whereas tumor cells are characterized by growing even in an environment such as soft agar, which is free of a physically strong support. Using this tumor-specific characteristic, cell colony-forming ability on soft agar was examined NCI-H460 lung cancer cells were treated with each of control miRNA, miR-34a, miR-8078, miR-3670, miR-4477a and miR-4765, and cultured for 24 hours. Next, the cells were mixed with soft agar and cultured in 6-well plates for 2 weeks. The cells were stained with crystal violet, and the number of colonies in each group was measured (FIG. 5). As a result, it could be seen that the cells treated with miR-8078 or miR-3670 formed little or no colonies, and the cells treated with miR-4477a showed colony-forming ability equal to about 30% of that of the control group.

Example 7: Measurement of Cell Proliferation Inhibitory Effects of miRNAs Upon Knock-Down of Target mRNA Target mRNA whose expression is controlled by miRNA has a sequence complementary to a portion of the miRNA sequence. The seed region sequence of the miRNA is particularly important in inhibition of mRNA, because the seed region sequence binds to mRNA having a sequence complementary thereto to inhibit gene expression. However, since the seed region sequence is relatively short (8-9 nucleotides), mRNAs to be targeted by miRNA are predicted using software. However, it is known that, even when software is used, only some of predicted targets are substantial targets. In order to overcome this disadvantage, the intracellular contents of target genes predicted through software were reduced using siRNA, and then whether or not the growth of the cells would be inhibited was determined, thereby selecting target genes. To predict target mRNAs to be targeted by miRNA, TargetScan that is generally used in the art was used as target prediction software, and about 600 kinds of genes predicted to be targeted by miR-3670, miR-4477a or miR-8078 were selected. For each of the selected genes, 3 kinds of siRNAs were synthesized, and using the synthesized siRNAs, the experiment was performed in the same manner as described in Example 3.

TABLE 3

Finally Selected miRNA Sequences

| | | | |
|---|---|---|---|
| SEQ ID NO: 35 | hsa-miR-3670 | Strand 1 | AGAGCUCACAGCUGUCCUUCUCUA |
| SEQ ID NO: 36 | hsa-miR-3670 | Strand 2 | GAGAAGGACAGCUGUGAGCUCUUU |
| SEQ ID NO: 67 | miR-3670-IC | IC | GACUGGUAUAGCUGCUUUUGGAGCCUCA |
| SEQ ID NO: 43 | hsa-miR-4477a | Strand 1 | CUAUUAAGGACAUUUGUGAUUC |
| SEQ ID NO: 44 | hsa-miR-4477a | Strand 2 | AUCACAAAUGUCCUUAAUAGUU |
| SEQ ID NO: 68 | miR-4477a-IC | IC | AUCACAAAUGUCCUUAAUGGCA |
| SEQ ID NO: 65 | hsa-miR-8078 | Strand 1 | GGUCUAGGCCCGGUGAGAGACUC |
| SEQ ID NO: 66 | hsa-miR-8078 | Strand 2 | GUCUCUCACCGGGCCUAGACCUU |
| SEQ ID NO: 69 | miR-8078-IC | IC | CUCCACCGGGCUGACCGGCCUG |

Specifically, cells were dispensed in 96-well plates, treated with each siRNA, and then cultured for 48 hours, after which the ability of the cell to proliferate was measured using Resazurin. In the same manner as described in Example 3, the Z-score of each gene was calculated from the mean of the values measured for a total of 1800 samples (about 600 genes×three different siRNAs). The results are shown in FIG. 6.

Example 8: Analysis of mRNA Targeted by miRNA miRNA acts to inhibit protein from being produced from mRNA and to induce degradation of most mRNAs targeted thereby. Thus, miRNA is transfected into cells, and the intracellular content of mRNA to be targeted by miRNA is analyzed by qPCR to determine whether or not the content would be reduced, thereby determining whether or not the miRNA would target the mRNA. In order to determine whether or not the intracellular contents of the target genes found in Example 7 would be substantially reduced when miRNA was delivered into cells, each of miR-3670, miR-4477a and miR-8078 was transfected into lung cancer cells which were then cultured for 48 hours, after which RNA was extracted from each cell, and the content of RNA in the cells was quantitatively measured (FIG. 7). As a result, it could be seen that the content of mRNA predicted to be targeted by each of miR-3670, miR-4477a and miR-8078 was significantly reduced.

Example 9: Examination of Target mRNA by Luciferase Assay miRNA binds to the 3' UTR (untranslated region) of target mRNA to inhibit protein from being produced from the target mRNA. For this reason, a luciferase assay method is generally used to directly measures the relationship between miRNA and target mRNA. Under TargetScan software, a 3' UTR sequence containing a miRNA-binding sequence was provided. As described in Example 2 above, the 3' UTR sequence was cloned into the 3' UTR of firefly luciferase to construct a vector. The constructed vector and miRNA were co-transfected into human embryonic kidney (HEK) cells, and the luciferase expression level of the vector was measured. To correct transfection efficiency, renilla luciferase was also transfected. After co-transfection of miRNA, firefly luciferase and renilla luciferase, the cells were cultured for 48 hours, and the luciferase activity of the cells was measured by a luminometer (FIG. 9). As a result, it could be seen that the target mRNA was controlled directly by the corresponding miRNA.

INDUSTRIAL APPLICABILITY

As described above, the pharmaceutical composition for treatment of cancer according to the present invention contains, as an active ingredient, one or more miRNAs selected from the group consisting of miR-3670, miR-4477a, and miR-8078. The pharmaceutical composition of the present invention exhibits improved anticancer effects compared to miR-34a, which is currently under clinical trials to determine suitability as an anticancer agent, and other pharmaceutical compositions for treatment of cancer, which contain other miRNAs as active ingredients. Thus, the pharmaceutical composition of the present invention can be widely used as an anticancer composition.

Although the present invention has been described in detail with reference to the specific features, it will be apparent to those skilled in the art that this description is only for a preferred embodiment and does not limit the scope of the present invention. Thus, the substantial scope of the present invention will be defined by the appended claims and equivalents thereof.

SEQUENCE LISTING (3525 sequences)

SEQ ID NO: 1 - RNA, 22 nt, Artificial Sequence
  Synthetic Construct
aucacauugccagugauuaccc

SEQ ID NO: 2 - RNA, 22 nt, Artificial Sequence
  Synthetic Construct
guaaucacuggcaaugugauuu

SEQ ID NO: 3 - RNA, 22 nt, Artificial Sequence
  Synthetic Construct
agauguccagccacaauucucg

SEQ ID NO: 4 - RNA, 23 nt, Artificial Sequence
  Synthetic Construct
agaauugcguuuggacaaucagu

SEQ ID NO: 5 - RNA, 25 nt, Artificial Sequence
  Synthetic Construct
acuggacuuggagucagaagagugg

SEQ ID NO: 6 - RNA, 25 nt, Artificial Sequence
  Synthetic Construct
acucuucugacuccaaguccaguuu

SEQ ID NO: 7 - RNA, 25 nt, Artificial Sequence
  Synthetic Construct
aaaaaccacaauuacuuuugcacca

SEQ ID NO: 8 - RNA, 25 nt, Artificial Sequence
  Synthetic Construct
gugcaaaaguaauugugguuuuuuu

SEQ ID NO: 9 - RNA, 23 nt, Artificial Sequence
  Synthetic Construct
caaagacugcaauuacuuuugcg

SEQ ID NO: 10 - RNA, 23 nt, Artificial Sequence
  Synthetic Construct
caaaaguaauugcagucuuuguu

SEQ ID NO: 11 - RNA, 21 nt, Artificial Sequence
  Synthetic Construct
ugaguuggccaucugagugag

SEQ ID NO: 12 - RNA, 21 nt, Artificial Sequence
  Synthetic Construct
cacucagauggccaacucauu

SEQ ID NO: 13 - RNA, 24 nt, Artificial Sequence
  Synthetic Construct
aaagacauaggauagagucaccuc

SEQ ID NO: 14 - RNA, 24 nt, Artificial Sequence
  Synthetic Construct
ggugacucuauccuaugucuuuuu

SEQ ID NO: 15 - RNA, 26 nt, Artificial Sequence
  Synthetic Construct
aaguaguugguuuguaugagaugguu

SEQ ID NO: 16 - RNA, 26 nt, Artificial Sequence
  Synthetic Construct
ccaucucauacaaaccaacuacuuuu

SEQ ID NO: 17 - RNA, 27 nt, Artificial Sequence
  Synthetic Construct
accuucuuguauaagcacugugcuaaa

SEQ ID NO: 18 - RNA, 27 nt, Artificial Sequence
  Synthetic Construct
uagcacagugcuuauacaagaagguuu

SEQ ID NO: 19 - RNA, 21 nt, Artificial Sequence
  Synthetic Construct
caucugggcaacugacugaac

SEQ ID NO: 20 - RNA, 22 nt, Artificial Sequence
  Synthetic Construct
uucauucggcuguccagaugua

SEQ ID NO: 21 - RNA, 20 nt, Artificial Sequence
  Synthetic Construct
uaggaugggggugagaggug

SEQ ID NO: 22 - RNA, 20 nt, Artificial Sequence
  Synthetic Construct
ccucucacccccauccuauu

SEQ ID NO: 23 - RNA, 20 nt, Artificial Sequence
  Synthetic Construct
uggcuuuuaacuuugauggc

SEQ ID NO: 24 - RNA, 20 nt, Artificial Sequence
  Synthetic Construct
caucaaaguuaaaagccauu

SEQ ID NO: 25 - RNA, 22 nt, Artificial Sequence
  Synthetic Construct
ugugacuuuaagggaaauggcg

SEQ ID NO: 26 - RNA, 22 nt, Artificial Sequence
  Synthetic Construct
ccauuucccuuaaagucacauu

SEQ ID NO: 27 - RNA, 23 nt, Artificial Sequence
  Synthetic Construct
agaggcuuugugcggauacgggg

SEQ ID NO: 28 - RNA, 23 nt, Artificial Sequence
  Synthetic Construct
ccguauccgcacaaagccucuuu

SEQ ID NO: 29 - RNA, 24 nt, Artificial Sequence
  Synthetic Construct
caaagugaugaguaauacuggcug

SEQ ID NO: 30 - RNA, 24 nt, Artificial Sequence
  Synthetic Construct
gccaguauuacucaucacuuuguu

SEQ ID NO: 31 - RNA, 22 nt, Artificial Sequence
  Synthetic Construct
aggaggcaucuugagaaaugga

SEQ ID NO: 32 - RNA, 22 nt, Artificial Sequence
  Synthetic Construct
cauuucucaagaugccuccuuu

SEQ ID NO: 33 - RNA, 24 nt, Artificial Sequence
  Synthetic Construct
gaaaaugaugaguagugacugaug

SEQ ID NO: 34 - RNA, 24 nt, Artificial Sequence
  Synthetic Construct
ucagucacuacucaucauuuucuu

SEQ ID NO: 35 - RNA, 24 nt, Artificial Sequence
  Synthetic Construct
agagcucacagcuguccuucucua

SEQ ID NO: 36 - RNA, 24 nt, Artificial Sequence
  Synthetic Construct
gagaaggacagcugugagcucuuu

SEQ ID NO: 37 - RNA, 23 nt, Artificial Sequence
  Synthetic Construct
uagcccccaggcuucacuuggcg

SEQ ID NO: 38 - RNA, 23 nt, Artificial Sequence
  Synthetic Construct
ccaagugaagccugggggcuauu

SEQ ID NO: 39 - RNA, 22 nt, Artificial Sequence
  Synthetic Construct
agaguuaacucaaaauggacua

SEQ ID NO: 40 - RNA, 22 nt, Artificial Sequence
  Synthetic Construct
guccauuuugaguuaacucuuu

SEQ ID NO: 41 - RNA, 23 nt, Artificial Sequence
  Synthetic Construct
gauugagacuaguagggcuaggc

SEQ ID NO: 42 - RNA, 23 nt, Artificial Sequence
  Synthetic Construct
cuagcccuacuagucucaaucuu

SEQ ID NO: 43 - RNA, 22 nt, Artificial Sequence
  Synthetic Construct
cuauuaaggacauuugugauuc

SEQ ID NO: 44 - RNA, 22 nt, Artificial Sequence
  Synthetic Construct
aucacaaauguccuuaauaguu

SEQ ID NO: 45 - RNA, 22 nt, Artificial Sequence
  Synthetic Construct
auuaaggacauuugugauugau

SEQ ID NO: 46 - RNA, 22 nt, Artificial Sequence
  Synthetic Construct
caaucacaaauguccuuaauuu

SEQ ID NO: 47 - RNA, 22 nt, Artificial Sequence
  Synthetic Construct
ugagugauugauagcuauguuc

SEQ ID NO: 48 - RNA, 22 nt, Artificial Sequence
  Synthetic Construct
acauagcuaucaaucacucauu

SEQ ID NO: 49 - RNA, 22 nt, Artificial Sequence
  Synthetic Construct
cagaacaggagcauagaaaggc

SEQ ID NO: 50 - RNA, 22 nt, Artificial Sequence
  Synthetic Construct
cuuucuaugcuccuguucuguu

SEQ ID NO: 51 - RNA, 22 nt, Artificial Sequence
  Synthetic Construct
guggaccaggauggcaagggcu

SEQ ID NO: 52 - RNA, 23 nt, Artificial Sequence
  Synthetic Construct
cuugccauccugguccacugcau

SEQ ID NO: 53 - RNA, 21 nt, Artificial Sequence
  Synthetic Construct
ugcuguauugucagguaguga

SEQ ID NO: 54 - RNA, 20 nt, Artificial Sequence
  Synthetic Construct
ucacuaccugacaauacagu

SEQ ID NO: 55 - RNA, 21 nt, Artificial Sequence
  Synthetic Construct
guuucaccauguuggucaggc

SEQ ID NO: 56 - RNA, 21 nt, Artificial Sequence
  Synthetic Construct
cugaccaacauggugaaacuu

SEQ ID NO: 57 - RNA, 22 nt, Artificial Sequence
  Synthetic Construct
ucaaguaguuucaugauaaagg

SEQ ID NO: 58 - RNA, 22 nt, Artificial Sequence
  Synthetic Construct
uuuaucaugaaacuacuugauu

SEQ ID NO: 59 - RNA, 23 nt, Artificial Sequence
  Synthetic Construct
uguuucggggcucauggccugug

SEQ ID NO: 60 - RNA, 23 nt, Artificial Sequence
  Synthetic Construct
caggccaugagccccgaaacauu

SEQ ID NO: 61 - RNA, 22 nt, Artificial Sequence
  Synthetic Construct
acguuugaaugcuguacaaggc

SEQ ID NO: 62 - RNA, 22 nt, Artificial Sequence
  Synthetic Construct
cuuguacagcauucaaacguuu

SEQ ID NO: 63 - RNA, 24 nt, Artificial Sequence
  Synthetic Construct
uggcgauuuuggaacucaauggca

SEQ ID NO: 64 - RNA, 24 nt, Artificial Sequence
  Synthetic Construct
ccauugaguuccaaaaucgccauu

SEQ ID NO: 65 - RNA, 23 nt, Artificial Sequence
  Synthetic Construct
ggucuaggcccggugagagacuc

SEQ ID NO: 66 - RNA, 23 nt, Artificial Sequence
  Synthetic Construct
gucucucaccgggccuagaccuu

SEQ ID NO: 67 - RNA, 28 nt, Artificial Sequence
  Synthetic Construct
gacugguauagcugcuuuuggagccuca

SEQ ID NO: 68 - RNA, 22 nt, Artificial Sequence
  Synthetic Construct
aucacaaauguccuuaauggca

SEQ ID NO: 69 - RNA, 22 nt, Artificial Sequence
  Synthetic Construct
cuccaccgggcugaccggccug

SEQ ID NO: 70 - RNA, 22 nt, Artificial Sequence
  Synthetic construct: hsa-let-7a-1
ugagguaguagguuguauaguu

SEQ ID NO: 71 - RNA, 21 nt, Artificial Sequence
  Synthetic construct: hsa-let-7a-1
cuauacaaucuacugucuuuc

SEQ ID NO: 72 - RNA, 22 nt, Artificial Sequence
  Synthetic construct: hsa-let-7a-2
ugagguaguagguuguauaguu

SEQ ID NO: 73 - RNA, 22 nt, Artificial Sequence
  Synthetic construct: hsa-let-7a-2
cuguacagccuccuagcuuucc

SEQ ID NO: 74 - RNA, 22 nt, Artificial Sequence
  Synthetic construct: hsa-let-7b
cuauacaaccuacugccuuccc

SEQ ID NO: 75 - RNA, 22 nt, Artificial Sequence
  Synthetic construct: hsa-let-7b
ugagguaguagguugugugguu

SEQ ID NO: 76 - RNA, 22 nt, Artificial Sequence
  Synthetic construct: hsa-let-7c
ugagguaguagguuguaugguu

SEQ ID NO: 77 - RNA, 22 nt, Artificial Sequence
  Synthetic construct: hsa-let-7c
cuguacaaccuucuagcuuucc

SEQ ID NO: 78 - RNA, 22 nt, Artificial Sequence
  Synthetic construct: hsa-let-7d
cuauacgaccugcugccuuucu

SEQ ID NO: 79 - RNA, 22 nt, Artificial Sequence
  Synthetic construct: hsa-let-7d
agagguaguagguugcauaguu

SEQ ID NO: 80 - RNA, 22 nt, Artificial Sequence
  Synthetic construct: hsa-let-7e
cuauacggccuccuagcuuucc

SEQ ID NO: 81 - RNA, 22 nt, Artificial Sequence
  Synthetic construct: hsa-let-7e
ugagguaggagguuguauaguu

SEQ ID NO: 82 - RNA, 22 nt, Artificial Sequence
  Synthetic construct: hsa-let-7f-1
ugagguaguagauuguauaguu

SEQ ID NO: 83 - RNA, 22 nt, Artificial Sequence
  Synthetic construct: hsa-let-7f-1
cuauacaaucuauugccuuccc

SEQ ID NO: 84 - RNA, 22 nt, Artificial Sequence
  Synthetic construct: hsa-let-7f-2
ugagguaguagauuguauaguu

SEQ ID NO: 85 - RNA, 22 nt, Artificial Sequence
  Synthetic construct: hsa-let-7f-2
cuauacagucuacugucuuucc

SEQ ID NO: 86 - RNA, 21 nt, Artificial Sequence
  Synthetic construct: hsa-let-7g
cuguacaggccacugccuugc

SEQ ID NO: 87 - RNA, 22 nt, Artificial Sequence
  Synthetic construct: hsa-let-7g
ugagguaguaguuuguacaguu

SEQ ID NO: 88 - RNA, 22 nt, Artificial Sequence
  Synthetic construct: hsa-let-7i
ugagguaguaguuugugcuguu

SEQ ID NO: 89 - RNA, 22 nt, Artificial Sequence
  Synthetic construct: hsa-let-7i
cugcgcaagcuacugccuugcu

SEQ ID NO: 90 - RNA, 22 nt, Artificial Sequence
  Synthetic construct: hsa-miR-1
uggaauguaaagaaguauguau

SEQ ID NO: 91 - RNA, 22 nt, Artificial Sequence
  Synthetic construct: hsa-miR-1
acauacuucuuuauaugcccau

SEQ ID NO: 92 - RNA, 22 nt, Artificial Sequence
  Synthetic construct: hsa-miR-100
caagcuuguaucuauagguaug

SEQ ID NO: 93 - RNA, 22 nt, Artificial Sequence
  Synthetic construct: hsa-miR-100
aacccguagauccgaacuugug

SEQ ID NO: 94 - RNA, 21 nt, Artificial Sequence
  Synthetic construct: hsa-miR-101
uacaguacugugauaacugaa

SEQ ID NO: 95 - RNA, 22 nt, Artificial Sequence
  Synthetic construct: hsa-miR-101
caguuaucacagugcugaugcu

SEQ ID NO: 96 - RNA, 23 nt, Artificial Sequence
  Synthetic construct: hsa-miR-103a
agcagcauuguacagggcuauga

SEQ ID NO: 97 - RNA, 23 nt, Artificial Sequence
  Synthetic construct: hsa-miR-103a
agcuucuuuacagugcugccuug

SEQ ID NO: 98 - RNA, 23 nt, Artificial Sequence
  Synthetic construct: hsa-miR-103b
ucauagcccuguacaaugcugcu

SEQ ID NO: 99 - RNA, 23 nt, Artificial Sequence
  Synthetic construct: hsa-miR-103b
cagcauuguacagggcuaugauu

SEQ ID NO: 100 - RNA, 23 nt, Artificial Sequence
  Synthetic construct: hsa-miR-105
ucaaaugcucagacuccuguggu

SEQ ID NO: 101 - RNA, 22 nt, Artificial Sequence
  Synthetic construct: hsa-miR-105
acggauguuugagcaugugcua

SEQ ID NO: 102 - RNA, 22 nt, Artificial Sequence
  Synthetic construct: hsa-miR-106a
cugcaauguaagcacuucuuac

SEQ ID NO: 103 - RNA, 23 nt, Artificial Sequence
  Synthetic construct: hsa-miR-106a
aaaagugcuuacagugcagguag

SEQ ID NO: 104 - RNA, 21 nt, Artificial Sequence
  Synthetic construct: hsa-miR-106b
uaaagugcugacagugcagau

SEQ ID NO: 105 - RNA, 22 nt, Artificial Sequence
  Synthetic construct: hsa-miR-106b
ccgcacuguggguacuugcugc

SEQ ID NO: 106 - RNA, 23 nt, Artificial Sequence
  Synthetic construct: hsa-miR-107
agcagcauuguacagggcuauca

SEQ ID NO: 107 - RNA, 23 nt, Artificial Sequence
  Synthetic construct: hsa-miR-107
auagcccuguacaaugcugcuuu

SEQ ID NO: 108 - RNA, 22 nt, Artificial Sequence
  Synthetic construct: hsa-miR-10a
caaauucguaucuaggggaaua

SEQ ID NO: 109 - RNA, 23 nt, Artificial Sequence
  Synthetic construct: hsa-miR-10a
uacccuguagauccgaauuugug

SEQ ID NO: 110 - RNA, 22 nt, Artificial Sequence
  Synthetic construct: hsa-miR-10b
acagauucgauucuaggggaau

SEQ ID NO: 111 - RNA, 23 nt, Artificial Sequence
  Synthetic construct: hsa-miR-10b
uacccuguagaaccgaauuugug

SEQ ID NO: 112 - RNA, 21 nt, Artificial Sequence
  Synthetic construct: hsa-miR-1178
uugcucacuguucuucccuag

SEQ ID NO: 113 - RNA, 18 nt, Artificial Sequence
  Synthetic construct: hsa-miR-1178
cagggucagcugagcaug

SEQ ID NO: 114 - RNA, 21 nt, Artificial Sequence
  Synthetic construct: hsa-miR-1179
aagcauucuuucauugguugg

SEQ ID NO: 115 - RNA, 21 nt, Artificial Sequence
  Synthetic construct: hsa-miR-1179
aaccaaugaaagaaugcuuuu

SEQ ID NO: 116 - RNA, 22 nt, Artificial Sequence
  Synthetic construct: hsa-miR-1180
uuuccggcucgcgugggugugu

SEQ ID NO: 117 - RNA, 21 nt, Artificial Sequence
  Synthetic construct: hsa-miR-1180
ggacccacccggccgggaaua

SEQ ID NO: 118 - RNA, 21 nt, Artificial Sequence
  Synthetic construct: hsa-miR-1181
ccgucgccgccacccgagccg

SEQ ID NO: 119 - RNA, 21 nt, Artificial Sequence
  Synthetic construct: hsa-miR-1181
gcucggguggcggcgacgguu

SEQ ID NO: 120 - RNA, 23 nt, Artificial Sequence
  Synthetic construct: hsa-miR-1182
gagggucuugggagggaugugac

SEQ ID NO: 121 - RNA, 23 nt, Artificial Sequence
  Synthetic construct: hsa-miR-1182
cacaucccucccaagacccucuu

SEQ ID NO: 122 - RNA, 27 nt, Artificial Sequence
  Synthetic construct: hsa-miR-1183
cacuguaggugauggugagagugggca

SEQ ID NO: 123 - RNA, 27 nt, Artificial Sequence
  Synthetic construct: hsa-miR-1183
cccacucucaccaucaccuacaguguu

SEQ ID NO: 124 - RNA, 23 nt, Artificial Sequence
  Synthetic construct: hsa-miR-1184
ccugcagcgacuugauggcuucc

SEQ ID NO: 125 - RNA, 23 nt, Artificial Sequence
  Synthetic construct: hsa-miR-1184
aagccaucaagucgcugcagguu

SEQ ID NO: 126 - RNA, 21 nt, Artificial Sequence
  Synthetic construct: hsa-miR-1185-1
agaggauacccuuuguauguu

SEQ ID NO: 127 - RNA, 22 nt, Artificial Sequence
  Synthetic construct: hsa-miR-1185-1
auauacagggggagacucuuau

SEQ ID NO: 128 - RNA, 21 nt, Artificial Sequence
  Synthetic construct: hsa-miR-1185-2
agaggauacccuuuguauguu

SEQ ID NO: 129 - RNA, 22 nt, Artificial Sequence
  Synthetic construct: hsa-miR-1185-2
auauacagggggagacucucau

SEQ ID NO: 130 - RNA, 23 nt, Artificial Sequence
  Synthetic construct: hsa-miR-1193
gggaugguagaccggugacgugc

SEQ ID NO: 131 - RNA, 23 nt, Artificial Sequence
  Synthetic construct: hsa-miR-1193
acgucaccggucuaccaucccuu

SEQ ID NO: 132 - RNA, 21 nt, Artificial Sequence
  Synthetic construct: hsa-miR-1197
uaggacacauggucuacuucu

SEQ ID NO: 133 - RNA, 21 nt, Artificial Sequence
  Synthetic construct: hsa-miR-1197
aaguagaccauguguccuauu

SEQ ID NO: 134 - RNA, 20 nt, Artificial Sequence
  Synthetic construct: hsa-miR-1199
ccugagcccgggccgcgcag

SEQ ID NO: 135 - RNA, 21 nt, Artificial Sequence
  Synthetic construct: hsa-miR-1199
ugcggccggugcucaaccugc

SEQ ID NO: 136 - RNA, 22 nt, Artificial Sequence
  Synthetic construct: hsa-miR-1200
cuccugagccauucugagccuc

SEQ ID NO: 137 - RNA, 22 nt, Artificial Sequence
  Synthetic construct: hsa-miR-1200
ggcucagaauggcucaggaguu

SEQ ID NO: 138 - RNA, 21 nt, Artificial Sequence
  Synthetic construct: hsa-miR-1202
gugccagcugcagugggggag

SEQ ID NO: 139 - RNA, 21 nt, Artificial Sequence
  Synthetic construct: hsa-miR-1202
cccccacugcagcuggcacuu

SEQ ID NO: 140 - RNA, 21 nt, Artificial Sequence
  Synthetic construct: hsa-miR-1203
cccggagccaggaugcagcuc

SEQ ID NO: 141 - RNA, 21 nt, Artificial Sequence
  Synthetic construct: hsa-miR-1203
gcugcauccuggcuccggguu

SEQ ID NO: 142 - RNA, 21 nt, Artificial Sequence
  Synthetic construct: hsa-miR-1204
ucguggccuggucuccauuau

SEQ ID NO: 143 - RNA, 21 nt, Artificial Sequence
  Synthetic construct: hsa-miR-1204
aauggagaccaggccacgauu

SEQ ID NO: 144 - RNA, 20 nt, Artificial Sequence
  Synthetic construct: hsa-miR-1205
ucugcaggguuugcuuugag

SEQ ID NO: 145 - RNA, 20 nt, Artificial Sequence
  Synthetic construct: hsa-miR-1205
caaagcaaacccugcagauu

SEQ ID NO: 146 - RNA, 21 nt, Artificial Sequence
  Synthetic construct: hsa-miR-1206
uguucauguagauguuuaagc

SEQ ID NO: 147 - RNA, 21 nt, Artificial Sequence
  Synthetic construct: hsa-miR-1206
uuaaacaucuacaugaacauu

SEQ ID NO: 148 - RNA, 21 nt, Artificial Sequence
  Synthetic construct: hsa-miR-1207
uggcagggaggcugggagggg

SEQ ID NO: 149 - RNA, 18 nt, Artificial Sequence
  Synthetic construct: hsa-miR-1207
ucagcuggcccucauuuc

SEQ ID NO: 150 - RNA, 20 nt, Artificial Sequence
  Synthetic construct: hsa-miR-1208
ucacuguucagacaggcgga

SEQ ID NO: 151 - RNA, 20 nt, Artificial Sequence
  Synthetic construct: hsa-miR-1208
cgccugucugaacagugauu

SEQ ID NO: 152 - RNA, 22 nt, Artificial Sequence
  Synthetic construct: hsa-miR-122
uggagugugacaaugguguuug

SEQ ID NO: 153 - RNA, 22 nt, Artificial Sequence
  Synthetic construct: hsa-miR-122
aacgccauuaucacacuaaaua

SEQ ID NO: 154 - RNA, 21 nt, Artificial Sequence
  Synthetic construct: hsa-miR-1224
ccccaccuccucucuccucag

SEQ ID NO: 155 - RNA, 19 nt, Artificial Sequence
  Synthetic construct: hsa-miR-1224
gugaggacucgggaggugg

SEQ ID NO: 156 - RNA, 22 nt, Artificial Sequence
  Synthetic construct: hsa-miR-1225
guggguacggcccagugggggg

SEQ ID NO: 157 - RNA, 22 nt, Artificial Sequence
  Synthetic construct: hsa-miR-1225
ugagccccugugccgcccccag

SEQ ID NO: 158 - RNA, 26 nt, Artificial Sequence
  Synthetic construct: hsa-miR-1226
gugagggcaugcaggccuggaugggg

SEQ ID NO: 159 - RNA, 22 nt, Artificial Sequence
  Synthetic construct: hsa-miR-1226
ucaccagcccuguguucccuag

SEQ ID NO: 160 - RNA, 17 nt, Artificial Sequence
  Synthetic construct: hsa-miR-1227
guggggccaggcggugg

SEQ ID NO: 161 - RNA, 20 nt, Artificial Sequence
  Synthetic construct: hsa-miR-1227
cgugccacccuuuuccccag

SEQ ID NO: 162 - RNA, 21 nt, Artificial Sequence
  Synthetic construct: hsa-miR-1228
gugggcgggggcaggugugug

SEQ ID NO: 163 - RNA, 20 nt, Artificial Sequence
  Synthetic construct: hsa-miR-1228
ucacaccugccucgcccccc

SEQ ID NO: 164 - RNA, 24 nt, Artificial Sequence
  Synthetic construct: hsa-miR-1229
guggguaggguuugggggagagcg

SEQ ID NO: 165 - RNA, 23 nt, Artificial Sequence
  Synthetic construct: hsa-miR-1229
cucucaccacugcccucccacag

SEQ ID NO: 166 - RNA, 20 nt, Artificial Sequence
  Synthetic construct: hsa-miR-1231
gugucugggcggacagcugc

SEQ ID NO: 167 - RNA, 20 nt, Artificial Sequence
  Synthetic construct: hsa-miR-1231
agcuguccgcccagacacuu

SEQ ID NO: 168 - RNA, 22 nt, Artificial Sequence
  Synthetic construct: hsa-miR-1233
agugggaggccagggcacggca

SEQ ID NO: 169 - RNA, 20 nt, Artificial Sequence
  Synthetic construct: hsa-miR-1233
ugagcccuguccucccgcag

SEQ ID NO: 170 - RNA, 22 nt, Artificial Sequence
  Synthetic construct: hsa-miR-1234
ucggccugaccacccaccccac

SEQ ID NO: 171 - RNA, 22 nt, Artificial Sequence
  Synthetic construct: hsa-miR-1234
gggguggguggucaggccgauu

SEQ ID NO: 172 - RNA, 22 nt, Artificial Sequence
  Synthetic construct: hsa-miR-1236
ugagugacaggggaaaugggga

SEQ ID NO: 173 - RNA, 22 nt, Artificial Sequence
  Synthetic construct: hsa-miR-1236
ccucuuccccuugucucuccag

SEQ ID NO: 174 - RNA, 21 nt, Artificial Sequence
  Synthetic construct: hsa-miR-1237
cgggggcggggccgaagcgcg

SEQ ID NO: 175 - RNA, 21 nt, Artificial Sequence
  Synthetic construct: hsa-miR-1237
uccuucugcuccgucccccag

SEQ ID NO: 176 - RNA, 20 nt, Artificial Sequence
  Synthetic construct: hsa-miR-1238
cuuccucgucugucugcccc

SEQ ID NO: 177 - RNA, 23 nt, Artificial Sequence
  Synthetic construct: hsa-miR-1238
gugagugggagccccagugugug

SEQ ID NO: 178 - RNA, 20 nt, Artificial Sequence
  Synthetic construct: hsa-miR-124
uaaggcacgcggugaaugcc

SEQ ID NO: 179 - RNA, 22 nt, Artificial Sequence
  Synthetic construct: hsa-miR-124
cguguucacagcggaccuugau

SEQ ID NO: 180 - RNA, 22 nt, Artificial Sequence
  Synthetic construct: hsa-miR-1243
aacuggaucaauuauaggagug

SEQ ID NO: 181 - RNA, 22 nt, Artificial Sequence
  Synthetic construct: hsa-miR-1243
cuccuauaauugauccaguuuu

SEQ ID NO: 182 - RNA, 26 nt, Artificial Sequence
  Synthetic construct: hsa-miR-1244
aaguaguugguuuguaugagaugguu

SEQ ID NO: 183 - RNA, 26 nt, Artificial Sequence
  Synthetic construct: hsa-miR-1244
ccaucucauacaaaccaacuacuuuu

SEQ ID NO: 184 - RNA, 21 nt, Artificial Sequence
  Synthetic construct: hsa-miR-1245a
aagugaucuaaaggccuacau

SEQ ID NO: 185 - RNA, 21 nt, Artificial Sequence
  Synthetic construct: hsa-miR-1245a
guaggccuuuagaucacuuuu

SEQ ID NO: 186 - RNA, 22 nt, Artificial Sequence
  Synthetic construct: hsa-miR-1245b
ucagaugaucuaaaggccuaua

SEQ ID NO: 187 - RNA, 21 nt, Artificial Sequence
  Synthetic construct: hsa-miR-1245b
uaggccuuuagaucacuuaaa

SEQ ID NO: 188 - RNA, 19 nt, Artificial Sequence
  Synthetic construct: hsa-miR-1246
aauggauuuuuggagcagg

SEQ ID NO: 189 - RNA, 19 nt, Artificial Sequence
  Synthetic construct: hsa-miR-1246
ugcuccaaaaauccauuuu

SEQ ID NO: 190 - RNA, 24 nt, Artificial Sequence
  Synthetic construct: hsa-miR-1247
ccccgggaacgucgagacuggagc

SEQ ID NO: 191 - RNA, 22 nt, Artificial Sequence
  Synthetic construct: hsa-miR-1247
acccgucccguucguccccgga

SEQ ID NO: 192 - RNA, 27 nt, Artificial Sequence
  Synthetic construct: hsa-miR-1248
accuucuuguauaagcacugugcuaaa

SEQ ID NO: 193 - RNA, 27 nt, Artificial Sequence
  Synthetic construct: hsa-miR-1248
uagcacagugcuuauacaagaagguuu

SEQ ID NO: 194 - RNA, 22 nt, Artificial Sequence
  Synthetic construct: hsa-miR-1249
acgcccuucccccccuucuuca

SEQ ID NO: 195 - RNA, 24 nt, Artificial Sequence
  Synthetic construct: hsa-miR-1249
aggagggaggagaugggccaaguu

SEQ ID NO: 196 - RNA, 19 nt, Artificial Sequence
  Synthetic construct: hsa-miR-1250
acauuuuccagcccauuca

SEQ ID NO: 197 - RNA, 21 nt, Artificial Sequence
  Synthetic construct: hsa-miR-1250
acggugcuggauguggccuuu

SEQ ID NO: 198 - RNA, 21 nt, Artificial Sequence
  Synthetic construct: hsa-miR-1251
cgcuuugcucagccaguguag

SEQ ID NO: 199 - RNA, 21 nt, Artificial Sequence
  Synthetic construct: hsa-miR-1251
acucuagcugccaaaggcgcu

SEQ ID NO: 200 - RNA, 22 nt, Artificial Sequence
  Synthetic construct: hsa-miR-1252
agaaggaaauugaauucauuua

SEQ ID NO: 201 - RNA, 22 nt, Artificial Sequence
  Synthetic construct: hsa-miR-1252
caaaugagcuuaauuuccuuuu

SEQ ID NO: 202 - RNA, 21 nt, Artificial Sequence
  Synthetic construct: hsa-miR-1253
agagaagaagaucagccugca

SEQ ID NO: 203 - RNA, 21 nt, Artificial Sequence
  Synthetic construct: hsa-miR-1253
caggcugaucuucuucucuuu

SEQ ID NO: 204 - RNA, 24 nt, Artificial Sequence
  Synthetic construct: hsa-miR-1254
agccuggaagcuggagccugcagu

SEQ ID NO: 205 - RNA, 24 nt, Artificial Sequence
  Synthetic construct: hsa-miR-1254
ugcaggcuccagcuuccaggcuuu

SEQ ID NO: 206 - RNA, 23 nt, Artificial Sequence
  Synthetic construct: hsa-miR-1255a
aggaugagcaaagaaaguagauu

SEQ ID NO: 207 - RNA, 23 nt, Artificial Sequence
  Synthetic construct: hsa-miR-1255a
ucuacuuucuuugcucauccuuu

SEQ ID NO: 208 - RNA, 22 nt, Artificial Sequence
  Synthetic construct: hsa-miR-1255b
aaccacuuucuuugcucaucca

SEQ ID NO: 209 - RNA, 22 nt, Artificial Sequence
  Synthetic construct: hsa-miR-1255b
cggaugagcaaagaaagugguu

SEQ ID NO: 210 - RNA, 22 nt, Artificial Sequence
  Synthetic construct: hsa-miR-1256
aggcauugacuucucacuagcu

SEQ ID NO: 211 - RNA, 22 nt, Artificial Sequence
  Synthetic construct: hsa-miR-1256
cuagugagaagucaaugccuuu

SEQ ID NO: 212 - RNA, 21 nt, Artificial Sequence
  Synthetic construct: hsa-miR-1257
agugaaugauggguucugacc

SEQ ID NO: 213 - RNA, 21 nt, Artificial Sequence
  Synthetic construct: hsa-miR-1257
ucagaacccaucauucacuuu

SEQ ID NO: 214 - RNA, 21 nt, Artificial Sequence
  Synthetic construct: hsa-miR-1258
aguuaggauuaggucguggaa

SEQ ID NO: 215 - RNA, 21 nt, Artificial Sequence
  Synthetic construct: hsa-miR-1258
ccacgaccuaauccuaacuuu

SEQ ID NO: 216 - RNA, 22 nt, Artificial Sequence
  Synthetic construct: hsa-miR-125a
acaggugagguucuugggagcc

SEQ ID NO: 217 - RNA, 24 nt, Artificial Sequence
  Synthetic construct: hsa-miR-125a
ucccugagacccuuuaaccuguga

SEQ ID NO: 218 - RNA, 22 nt, Artificial Sequence
  Synthetic construct: hsa-miR-125b-1
ucccugagacccuaacuuguga

SEQ ID NO: 219 - RNA, 22 nt, Artificial Sequence
  Synthetic construct: hsa-miR-125b-1
acggguuaggcucuugggagcu

SEQ ID NO: 220 - RNA, 22 nt, Artificial Sequence
  Synthetic construct: hsa-miR-125b-2
ucccugagacccuaacuuguga

SEQ ID NO: 221 - RNA, 22 nt, Artificial Sequence
  Synthetic construct: hsa-miR-125b-2
ucacaagucaggcucuugggac

SEQ ID NO: 222 - RNA, 22 nt, Artificial Sequence
  Synthetic construct: hsa-miR-126
ucguaccgugaguaauaaugcg

SEQ ID NO: 223 - RNA, 21 nt, Artificial Sequence
  Synthetic construct: hsa-miR-126
cauuauuacuuuugguacgcg

SEQ ID NO: 224 - RNA, 18 nt, Artificial Sequence
  Synthetic construct: hsa-miR-1260a
aucccaccucugccacca

SEQ ID NO: 225 - RNA, 18 nt, Artificial Sequence
  Synthetic construct: hsa-miR-1260a
guggcagaggugggauuu

SEQ ID NO: 226 - RNA, 19 nt, Artificial Sequence
  Synthetic construct: hsa-miR-1260b
aucccaccacugccaccau

SEQ ID NO: 227 - RNA, 19 nt, Artificial Sequence
  Synthetic construct: hsa-miR-1260b
gguggcaguggugggauuu

SEQ ID NO: 228 - RNA, 19 nt, Artificial Sequence
  Synthetic construct: hsa-miR-1261
auggauaaggcuuuggcuu

SEQ ID NO: 229 - RNA, 19 nt, Artificial Sequence
  Synthetic construct: hsa-miR-1261
gccaaagccuuauccauuu

SEQ ID NO: 230 - RNA, 22 nt, Artificial Sequence
  Synthetic construct: hsa-miR-1262
augggugaauuuguagaaggau

SEQ ID NO: 231 - RNA, 22 nt, Artificial Sequence
  Synthetic construct: hsa-miR-1262
ccuucuacaaauucacccauuu

SEQ ID NO: 232 - RNA, 22 nt, Artificial Sequence
  Synthetic construct: hsa-miR-1263
augguacccuggcauacugagu

SEQ ID NO: 233 - RNA, 22 nt, Artificial Sequence
  Synthetic construct: hsa-miR-1263
ucaguaugccaggguaccauuu

SEQ ID NO: 234 - RNA, 23 nt, Artificial Sequence
  Synthetic construct: hsa-miR-1264
caagucuuauuugagcaccuguu

SEQ ID NO: 235 - RNA, 23 nt, Artificial Sequence
  Synthetic construct: hsa-miR-1264
caggugcucaaauaagacuuguu

SEQ ID NO: 236 - RNA, 22 nt, Artificial Sequence
  Synthetic construct: hsa-miR-1265
caggauguggucaaguguuguu

SEQ ID NO: 237 - RNA, 22 nt, Artificial Sequence
  Synthetic construct: hsa-miR-1265
caacacuugaccacauccuguu

SEQ ID NO: 238 - RNA, 23 nt, Artificial Sequence
  Synthetic construct: hsa-miR-1266
ccucagggcuguagaacagggcu

SEQ ID NO: 239 - RNA, 22 nt, Artificial Sequence
  Synthetic construct: hsa-miR-1266
cccuguucuaugcccugaggga

SEQ ID NO: 240 - RNA, 21 nt, Artificial Sequence
  Synthetic construct: hsa-miR-1267
ccuguugaaguguaaucccca

SEQ ID NO: 241 - RNA, 21 nt, Artificial Sequence
  Synthetic construct: hsa-miR-1267
gggauuacacuucaacagguu

SEQ ID NO: 242 - RNA, 18 nt, Artificial Sequence
  Synthetic construct: hsa-miR-1268a
cgggcguggugguggggg

SEQ ID NO: 243 - RNA, 18 nt, Artificial Sequence
  Synthetic construct: hsa-miR-1268a
cccaccaccacgcccguu

SEQ ID NO: 244 - RNA, 20 nt, Artificial Sequence
  Synthetic construct: hsa-miR-1268b
cgggcgugguggugggggug

SEQ ID NO: 245 - RNA, 20 nt, Artificial Sequence
  Synthetic construct: hsa-miR-1268b
cccccaccaccacgcccguu

SEQ ID NO: 246 - RNA, 22 nt, Artificial Sequence
  Synthetic construct: hsa-miR-1269a
cuggacugagccgugcuacugg

SEQ ID NO: 247 - RNA, 22 nt, Artificial Sequence
  Synthetic construct: hsa-miR-1269a
aguagcacggcucaguccaguu

SEQ ID NO: 248 - RNA, 22 nt, Artificial Sequence
  Synthetic construct: hsa-miR-1269b
cuggacugagccaugcuacugg

SEQ ID NO: 249 - RNA, 22 nt, Artificial Sequence
  Synthetic construct: hsa-miR-1269b
aguagcauggcucaguccaguu

SEQ ID NO: 250 - RNA, 22 nt, Artificial Sequence
  Synthetic construct: hsa-miR-127
ucggauccgucugagcuuggcu

SEQ ID NO: 251 - RNA, 22 nt, Artificial Sequence
  Synthetic construct: hsa-miR-127
cugaagcucagagggcucugau

SEQ ID NO: 252 - RNA, 23 nt, Artificial Sequence
  Synthetic construct: hsa-miR-1270
cuggagauauggaagagcugugu

SEQ ID NO: 253 - RNA, 23 nt, Artificial Sequence
  Synthetic construct: hsa-miR-1270
acagcucuuccauaucuccaguu

SEQ ID NO: 254 - RNA, 22 nt, Artificial Sequence
  Synthetic construct: hsa-miR-1271
agugccugcuaugugccaggca

SEQ ID NO: 255 - RNA, 22 nt, Artificial Sequence
  Synthetic construct: hsa-miR-1271
cuuggcaccuagcaagcacuca

SEQ ID NO: 256 - RNA, 26 nt, Artificial Sequence
  Synthetic construct: hsa-miR-1272
gaugaugauggcagcaaauucugaaa

SEQ ID NO: 257 - RNA, 26 nt, Artificial Sequence
  Synthetic construct: hsa-miR-1272
ucagaauuugcugccaucaucaucuu

SEQ ID NO: 258 - RNA, 25 nt, Artificial Sequence
  Synthetic construct: hsa-miR-1273a
gggcgacaaagcaagacucuuucuu

SEQ ID NO: 259 - RNA, 25 nt, Artificial Sequence
  Synthetic construct: hsa-miR-1273a
gaaagagucuugcuuugucgcccuu

SEQ ID NO: 260 - RNA, 22 nt, Artificial Sequence
  Synthetic construct: hsa-miR-1273c
ggcgacaaaacgagacccuguc

SEQ ID NO: 261 - RNA, 22 nt, Artificial Sequence
  Synthetic construct: hsa-miR-1273c
cagggucucguuuugucgccuu

SEQ ID NO: 262 - RNA, 25 nt, Artificial Sequence
  Synthetic construct: hsa-miR-1273d
gaacccaugagguugaggcugcagu

SEQ ID NO: 263 - RNA, 25 nt, Artificial Sequence
  Synthetic construct: hsa-miR-1273d
ugcagccucaaccucauggguucuu

SEQ ID NO: 264 - RNA, 22 nt, Artificial Sequence
  Synthetic construct: hsa-miR-1273e
uugcuugaacccaggaagugga

SEQ ID NO: 265 - RNA, 22 nt, Artificial Sequence
  Synthetic construct: hsa-miR-1273e
cacuuccuggguucaagcaauu

SEQ ID NO: 266 - RNA, 19 nt, Artificial Sequence
  Synthetic construct: hsa-miR-1273f
ggagauggagguugcagug

SEQ ID NO: 267 - RNA, 19 nt, Artificial Sequence
  Synthetic construct: hsa-miR-1273f
cugcaaccuccaucuccuu

SEQ ID NO: 268 - RNA, 22 nt, Artificial Sequence
  Synthetic construct: hsa-miR-1273g
ggugguugaggcugcaguaagu

SEQ ID NO: 269 - RNA, 21 nt, Artificial Sequence
  Synthetic construct: hsa-miR-1273g
accacugcacuccagccugag

SEQ ID NO: 270 - RNA, 21 nt, Artificial Sequence
  Synthetic construct: hsa-miR-1273h
cugggaggucaaggcugcagu

SEQ ID NO: 271 - RNA, 22 nt, Artificial Sequence
  Synthetic construct: hsa-miR-1273h
cugcagacucgaccucccaggc

SEQ ID NO: 272 - RNA, 17 nt, Artificial Sequence
  Synthetic construct: hsa-miR-1275
gugggggagaggcuguc

SEQ ID NO: 273 - RNA, 17 nt, Artificial Sequence
  Synthetic construct: hsa-miR-1275
cagccucucccccacuu

SEQ ID NO: 274 - RNA, 20 nt, Artificial Sequence
  Synthetic construct: hsa-miR-1276
uaaagagcccuguggagaca

SEQ ID NO: 275 - RNA, 20 nt, Artificial Sequence
  Synthetic construct: hsa-miR-1276
ucuccacagggcucuuuauu

SEQ ID NO: 276 - RNA, 22 nt, Artificial Sequence
  Synthetic construct: hsa-miR-1277
uacguagauauauauguauuuu

SEQ ID NO: 277 - RNA, 24 nt, Artificial Sequence
  Synthetic construct: hsa-miR-1277
aaauauauauauauauguacguau

SEQ ID NO: 278 - RNA, 22 nt, Artificial Sequence
  Synthetic construct: hsa-miR-1278
uaguacugugcauaucaucuau

SEQ ID NO: 279 - RNA, 22 nt, Artificial Sequence
  Synthetic construct: hsa-miR-1278
agaugauaugcacaguacuauu

SEQ ID NO: 280 - RNA, 17 nt, Artificial Sequence
  Synthetic construct: hsa-miR-1279
ucauauugcuucuuucu

SEQ ID NO: 281 - RNA, 17 nt, Artificial Sequence
  Synthetic construct: hsa-miR-1279
aaagaagcaauaugauu

SEQ ID NO: 282 - RNA, 21 nt, Artificial Sequence
  Synthetic construct: hsa-miR-128-1
ucacagugaaccggucucuuu

SEQ ID NO: 283 - RNA, 23 nt, Artificial Sequence
  Synthetic construct: hsa-miR-128-1
cggggccguagcacugucugaga

SEQ ID NO: 284 - RNA, 21 nt, Artificial Sequence
  Synthetic construct: hsa-miR-128-2
ucacagugaaccggucucuuu

SEQ ID NO: 285 - RNA, 23 nt, Artificial Sequence
  Synthetic construct: hsa-miR-128-2
gggggccgauacacuguacgaga

SEQ ID NO: 286 - RNA, 17 nt, Artificial Sequence
  Synthetic construct: hsa-miR-1281
ucgccuccuccucuccc

SEQ ID NO: 287 - RNA, 17 nt, Artificial Sequence
  Synthetic construct: hsa-miR-1281
gagaggaggaggcgauu

SEQ ID NO: 288 - RNA, 20 nt, Artificial Sequence
  Synthetic construct: hsa-miR-1282
ucguuugccuuuuucugcuu

SEQ ID NO: 289 - RNA, 20 nt, Artificial Sequence
  Synthetic construct: hsa-miR-1282
gcagaaaaaggcaaacgauu

SEQ ID NO: 290 - RNA, 22 nt, Artificial Sequence
  Synthetic construct: hsa-miR-1283
ucuacaaaggaaagcgcuuucu

SEQ ID NO: 291 - RNA, 22 nt, Artificial Sequence
  Synthetic construct: hsa-miR-1283
aaagcgcuuuccuuuguagauu

SEQ ID NO: 292 - RNA, 22 nt, Artificial Sequence
  Synthetic construct: hsa-miR-1284
ucuauacagacccuggcuuuuc

SEQ ID NO: 293 - RNA, 22 nt, Artificial Sequence
  Synthetic construct: hsa-miR-1284
aaagccagggucuguauagauu

SEQ ID NO: 294 - RNA, 22 nt, Artificial Sequence
  Synthetic construct: hsa-miR-1285
ucugggcaacaaagugagaccu

SEQ ID NO: 295 - RNA, 21 nt, Artificial Sequence
  Synthetic construct: hsa-miR-1285
gaucucacuuuguugcccagg

SEQ ID NO: 296 - RNA, 21 nt, Artificial Sequence
  Synthetic construct: hsa-miR-1286
ugcaggaccaagaugagcccu

SEQ ID NO: 297 - RNA, 21 nt, Artificial Sequence
  Synthetic construct: hsa-miR-1286
ggcucaucuugguccugcauu

SEQ ID NO: 298 - RNA, 22 nt, Artificial Sequence
  Synthetic construct: hsa-miR-1287
cucuagccacagaugcagugau

SEQ ID NO: 299 - RNA, 22 nt, Artificial Sequence
  Synthetic construct: hsa-miR-1287
ugcuggaucagugguucgaguc

SEQ ID NO: 300 - RNA, 21 nt, Artificial Sequence
  Synthetic construct: hsa-miR-1288
uggacugcccugaucuggaga

SEQ ID NO: 301 - RNA, 23 nt, Artificial Sequence
  Synthetic construct: hsa-miR-1288
gcagaucaggacuguaacucacc

SEQ ID NO: 302 - RNA, 23 nt, Artificial Sequence
  Synthetic construct: hsa-miR-1289
uggaguccaggaaucugcauuuu

SEQ ID NO: 303 - RNA, 23 nt, Artificial Sequence
  Synthetic construct: hsa-miR-1289
aaugcagauuccuggacuccauu

SEQ ID NO: 304 - RNA, 21 nt, Artificial Sequence
  Synthetic construct: hsa-miR-129-1
cuuuuugcggucugggcuugc

SEQ ID NO: 305 - RNA, 22 nt, Artificial Sequence
  Synthetic construct: hsa-miR-129-1
aagcccuuaccccaaaaaguau

SEQ ID NO: 306 - RNA, 21 nt, Artificial Sequence
  Synthetic construct: hsa-miR-129-2
cuuuuugcggucugggcuugc

SEQ ID NO: 307 - RNA, 22 nt, Artificial Sequence
  Synthetic construct: hsa-miR-129-2
aagcccuuaccccaaaaagcau

SEQ ID NO: 308 - RNA, 19 nt, Artificial Sequence
  Synthetic construct: hsa-miR-1290
uggauuuuuggaucaggga

SEQ ID NO: 309 - RNA, 19 nt, Artificial Sequence
  Synthetic construct: hsa-miR-1290
ccugauccaaaaauccauu

SEQ ID NO: 310 - RNA, 24 nt, Artificial Sequence
  Synthetic construct: hsa-miR-1291
uggcccugacugaagaccagcagu

SEQ ID NO: 311 - RNA, 24 nt, Artificial Sequence
  Synthetic construct: hsa-miR-1291
ugcuggucuucagucagggccauu

SEQ ID NO: 312 - RNA, 25 nt, Artificial Sequence
  Synthetic construct: hsa-miR-1292
ugggaacggguuccggcagacgcug

SEQ ID NO: 313 - RNA, 20 nt, Artificial Sequence
  Synthetic construct: hsa-miR-1292
ucgcgccccggcucccguuc

SEQ ID NO: 314 - RNA, 22 nt, Artificial Sequence
  Synthetic construct: hsa-miR-1293
uggguggucuggagauuugugc

SEQ ID NO: 315 - RNA, 22 nt, Artificial Sequence
  Synthetic construct: hsa-miR-1293
acaaaucuccagaccacccauu

SEQ ID NO: 316 - RNA, 22 nt, Artificial Sequence
  Synthetic construct: hsa-miR-1294
ugugagguuggcauuguugucu

SEQ ID NO: 317 - RNA, 22 nt, Artificial Sequence
  Synthetic construct: hsa-miR-1294
acaacaaugccaaccucacauu

SEQ ID NO: 318 - RNA, 21 nt, Artificial Sequence
  Synthetic construct: hsa-miR-1295a
uuaggccgcagaucuggguga

SEQ ID NO: 319 - RNA, 21 nt, Artificial Sequence
  Synthetic construct: hsa-miR-1295a
acccagaucugcggccuaauu

SEQ ID NO: 320 - RNA, 22 nt, Artificial Sequence
  Synthetic construct: hsa-miR-1295b
aauaggccacggaucugggcaa

SEQ ID NO: 321 - RNA, 21 nt, Artificial Sequence
  Synthetic construct: hsa-miR-1295b
cacccagaucugcggccuaau

SEQ ID NO: 322 - RNA, 22 nt, Artificial Sequence
  Synthetic construct: hsa-miR-1296
uuagggcccuggcuccaucucc

SEQ ID NO: 323 - RNA, 22 nt, Artificial Sequence
  Synthetic construct: hsa-miR-1296
gaguggggcuucgacccuaacc

SEQ ID NO: 324 - RNA, 17 nt, Artificial Sequence
  Synthetic construct: hsa-miR-1297
uucaaguaauucaggug

SEQ ID NO: 325 - RNA, 17 nt, Artificial Sequence
  Synthetic construct: hsa-miR-1297
ccugaauuacuugaauu

SEQ ID NO: 326 - RNA, 21 nt, Artificial Sequence
  Synthetic construct: hsa-miR-1298
caucugggcaacugacugaac

SEQ ID NO: 327 - RNA, 22 nt, Artificial Sequence
  Synthetic construct: hsa-miR-1298
uucauucggcuguccagaugua

SEQ ID NO: 328 - RNA, 22 nt, Artificial Sequence
  Synthetic construct: hsa-miR-1299
uucuggaauucugugugaggga

SEQ ID NO: 329 - RNA, 22 nt, Artificial Sequence
  Synthetic construct: hsa-miR-1299
ccucacacagaauuccagaauu

SEQ ID NO: 330 - RNA, 19 nt, Artificial Sequence
  Synthetic construct: hsa-miR-1301
cgcucuaggcaccgcagca

SEQ ID NO: 331 - RNA, 24 nt, Artificial Sequence
  Synthetic construct: hsa-miR-1301
uugcagcugccugggagugacuuc

SEQ ID NO: 332 - RNA, 21 nt, Artificial Sequence
  Synthetic construct: hsa-miR-1302
uugggacauacuuaugcuaaa

SEQ ID NO: 333 - RNA, 21 nt, Artificial Sequence
  Synthetic construct: hsa-miR-1302
uagcauaaguaugucccaauu

SEQ ID NO: 334 - RNA, 22 nt, Artificial Sequence
  Synthetic construct: hsa-miR-1303
uuuagagacggggucuugcucu

SEQ ID NO: 335 - RNA, 22 nt, Artificial Sequence
  Synthetic construct: hsa-miR-1303
agcaagaccccgucucuaaauu

SEQ ID NO: 336 - RNA, 22 nt, Artificial Sequence
  Synthetic construct: hsa-miR-1304
uuugaggcuacagugagaugug

SEQ ID NO: 337 - RNA, 22 nt, Artificial Sequence
  Synthetic construct: hsa-miR-1304
ucucacuguagccucgaacccc

SEQ ID NO: 338 - RNA, 22 nt, Artificial Sequence
  Synthetic construct: hsa-miR-1305
uuuucaacucuaaugggagaga

SEQ ID NO: 339 - RNA, 22 nt, Artificial Sequence
  Synthetic construct: hsa-miR-1305
ucucccauuagaguugaaaauu

SEQ ID NO: 340 - RNA, 22 nt, Artificial Sequence
  Synthetic construct: hsa-miR-1306
ccaccuccccugcaaacgucca

SEQ ID NO: 341 - RNA, 18 nt, Artificial Sequence
  Synthetic construct: hsa-miR-1306
acguuggcucugguggug

SEQ ID NO: 342 - RNA, 22 nt, Artificial Sequence
  Synthetic construct: hsa-miR-1307
acucggcguggcgucggucgug

SEQ ID NO: 343 - RNA, 21 nt, Artificial Sequence
  Synthetic construct: hsa-miR-1307
ucgaccggaccucgaccggcu

SEQ ID NO: 344 - RNA, 22 nt, Artificial Sequence
  Synthetic construct: hsa-miR-130a
uucacauugugcuacugucugc

SEQ ID NO: 345 - RNA, 22 nt, Artificial Sequence
  Synthetic construct: hsa-miR-130a
cagugcaauguuaaaagggcau

SEQ ID NO: 346 - RNA, 22 nt, Artificial Sequence
  Synthetic construct: hsa-miR-130b
cagugcaaugaugaaagggcau

SEQ ID NO: 347 - RNA, 21 nt, Artificial Sequence
  Synthetic construct: hsa-miR-130b
acucuuucccuguugcacuac

SEQ ID NO: 348 - RNA, 22 nt, Artificial Sequence
  Synthetic construct: hsa-miR-132
uaacagucuacagccauggucg

SEQ ID NO: 349 - RNA, 22 nt, Artificial Sequence
  Synthetic construct: hsa-miR-132
accguggcuuucgauuguuacu

SEQ ID NO: 350 - RNA, 18 nt, Artificial Sequence
  Synthetic construct: hsa-miR-1321
cagggaggugaaugugau

SEQ ID NO: 351 - RNA, 18 nt, Artificial Sequence
  Synthetic construct: hsa-miR-1321
cacauucaccucccuguu

SEQ ID NO: 352 - RNA, 19 nt, Artificial Sequence
  Synthetic construct: hsa-miR-1322
gaugaugcugcugaugcug

SEQ ID NO: 353 - RNA, 19 nt, Artificial Sequence
  Synthetic construct: hsa-miR-1322
gcaucagcagcaucaucuu

SEQ ID NO: 354 - RNA, 22 nt, Artificial Sequence
  Synthetic construct: hsa-miR-1323
ucaaaacugaggggcauuuucu

SEQ ID NO: 355 - RNA, 22 nt, Artificial Sequence
  Synthetic construct: hsa-miR-1323
aaaaugccccucaguuuugauu

SEQ ID NO: 356 - RNA, 24 nt, Artificial Sequence
  Synthetic construct: hsa-miR-1324
ccagacagaauucuaugcacuuuc

SEQ ID NO: 357 - RNA, 24 nt, Artificial Sequence
  Synthetic construct: hsa-miR-1324
aagugcauagaauucugucugguu

SEQ ID NO: 358 - RNA, 22 nt, Artificial Sequence
  Synthetic construct: hsa-miR-133a
agcugguaaaauggaaccaaau

SEQ ID NO: 359 - RNA, 22 nt, Artificial Sequence
  Synthetic construct: hsa-miR-133a
uuugguccccuucaaccagcug

SEQ ID NO: 360 - RNA, 22 nt, Artificial Sequence
  Synthetic construct: hsa-miR-133b
uuugguccccuucaaccagcua

SEQ ID NO: 361 - RNA, 22 nt, Artificial Sequence
  Synthetic construct: hsa-miR-133b
gcugguugaaggggaccaaauu

SEQ ID NO: 362 - RNA, 22 nt, Artificial Sequence
  Synthetic construct: hsa-miR-134
ugugacugguugaccagagggg

SEQ ID NO: 363 - RNA, 23 nt, Artificial Sequence
  Synthetic construct: hsa-miR-134
ccugugggccaccuagucaccaa

SEQ ID NO: 364 - RNA, 22 nt, Artificial Sequence
  Synthetic construct: hsa-miR-1343
cuccuggggcccgcacucucgc

SEQ ID NO: 365 - RNA, 22 nt, Artificial Sequence
  Synthetic construct: hsa-miR-1343
uggggagcggcccccggguggg

SEQ ID NO: 366 - RNA, 22 nt, Artificial Sequence
  Synthetic construct: hsa-miR-135a
uauagggauuggagccguggcg

SEQ ID NO: 367 - RNA, 23 nt, Artificial Sequence
  Synthetic construct: hsa-miR-135a
uauggcuuuuuauuccuauguga

SEQ ID NO: 368 - RNA, 22 nt, Artificial Sequence
  Synthetic construct: hsa-miR-135b
auguagggcuaaaagccauggg

SEQ ID NO: 369 - RNA, 23 nt, Artificial Sequence
  Synthetic construct: hsa-miR-135b
uauggcuuuucauuccuauguga

SEQ ID NO: 370 - RNA, 22 nt, Artificial Sequence
  Synthetic construct: hsa-miR-136
caucaucgucucaaaugagucu

SEQ ID NO: 371 - RNA, 23 nt, Artificial Sequence
  Synthetic construct:
acuccauuuguuuugaugaugga

SEQ ID NO: 372 - RNA, 23 nt, Artificial Sequence
  Synthetic construct: hsa-miR-137
uuauugcuuaagaauacgcguag

SEQ ID NO: 373 - RNA, 23 nt, Artificial Sequence
  Synthetic construct: hsa-miR-137
acgcguauucuuaagcaauaauu

SEQ ID NO: 374 - RNA, 23 nt, Artificial Sequence
  Synthetic construct: hsa-miR-138-1
agcugguguugugaaucaggccg

SEQ ID NO: 375 - RNA, 22 nt, Artificial Sequence
  Synthetic construct: hsa-miR-138-1
gcuacuucacaacaccagggcc

SEQ ID NO: 376 - RNA, 23 nt, Artificial Sequence
  Synthetic construct: hsa-miR-138-2
agcugguguugugaaucaggccg

SEQ ID NO: 377 - RNA, 22 nt, Artificial Sequence
  Synthetic construct: hsa-miR-138-2
gcuauuucacgacaccaggguu

SEQ ID NO: 378 - RNA, 23 nt, Artificial Sequence
  Synthetic construct: hsa-miR-139
ucuacagugcacgugucuccagu

SEQ ID NO: 379 - RNA, 23 nt, Artificial Sequence
  Synthetic construct: hsa-miR-139
uggagacgcggcccuguuggagu

SEQ ID NO: 380 - RNA, 22 nt, Artificial Sequence
  Synthetic construct: hsa-miR-140
cagugguuuuacccuaugguag

SEQ ID NO: 381 - RNA, 21 nt, Artificial Sequence
  Synthetic construct: hsa-miR-140
uaccacaggguagaaccacgg

SEQ ID NO: 382 - RNA, 22 nt, Artificial Sequence
  Synthetic construct: hsa-miR-141
uaacacugucugguaaagaugg

SEQ ID NO: 383 - RNA, 22 nt, Artificial Sequence
  Synthetic construct: hsa-miR-141
caucuuccaguacaguguugga

SEQ ID NO: 384 - RNA, 21 nt, Artificial Sequence
  Synthetic construct: hsa-miR-142
cauaaaguagaaagcacuacu

SEQ ID NO: 385 - RNA, 23 nt, Artificial Sequence
  Synthetic construct: hsa-miR-142
uguaguguuuccuacuuuaugga

SEQ ID NO: 386 - RNA, 22 nt, Artificial Sequence
  Synthetic construct: hsa-miR-143
ggugcagugcugcaucucuggu

SEQ ID NO: 387 - RNA, 21 nt, Artificial Sequence
  Synthetic construct: hsa-miR-143
ugagaugaagcacuguagcuc

SEQ ID NO: 388 - RNA, 20 nt, Artificial Sequence
  Synthetic construct: hsa-miR-144
uacaguauagaugauguacu

SEQ ID NO: 389 - RNA, 22 nt, Artificial Sequence
  Synthetic construct: hsa-miR-144
ggauaucaucauauacuguaag

SEQ ID NO: 390 - RNA, 23 nt, Artificial Sequence
  Synthetic construct: hsa-miR-145
guccaguuuucccaggaaucccu

SEQ ID NO: 391 - RNA, 22 nt, Artificial Sequence
  Synthetic construct: hsa-miR-145
ggauuccuggaaauacuguucu

SEQ ID NO: 392 - RNA, 21 nt, Artificial Sequence
  Synthetic construct: hsa-miR-1468
cuccguuugccuguuucgcug

SEQ ID NO: 393 - RNA, 22 nt, Artificial Sequence
  Synthetic construct: hsa-miR-1468
agcaaaauaagcaaauggaaaa

SEQ ID NO: 394 - RNA, 22 nt, Artificial Sequence
  Synthetic construct: hsa-miR-1469
cucggcgcggggcgcgggcucc

SEQ ID NO: 395 - RNA, 22 nt, Artificial Sequence
  Synthetic construct: hsa-miR-1469
agcccgcgccccgcgccgaguu

SEQ ID NO: 396 - RNA, 22 nt, Artificial Sequence
  Synthetic construct: hsa-miR-146a
ugagaacugaauuccauggguu

SEQ ID NO: 397 - RNA, 22 nt, Artificial Sequence
  Synthetic construct: hsa-miR-146a
ccucugaaauucaguucuucag

SEQ ID NO: 398 - RNA, 22 nt, Artificial Sequence
  Synthetic construct: hsa-miR-146b
ugcccuguggacucaguucugg

SEQ ID NO: 399 - RNA, 22 nt, Artificial Sequence
  Synthetic construct: hsa-miR-146b
ugagaacugaauuccauaggcu

SEQ ID NO: 400 - RNA, 21 nt, Artificial Sequence
  Synthetic construct: hsa-miR-1470
gcccuccgcccgugcaccccg

SEQ ID NO: 401 - RNA, 21 nt, Artificial Sequence
  Synthetic construct: hsa-miR-1470
gggugcacgggcggagggcuu

SEQ ID NO: 402 - RNA, 22 nt, Artificial Sequence
  Synthetic construct: hsa-miR-1471
gcccgcguguggagccaggugu

SEQ ID NO: 403 - RNA, 22 nt, Artificial Sequence
  Synthetic construct: hsa-miR-1471
accuggcuccacacgcgggcuu

SEQ ID NO: 404 - RNA, 20 nt, Artificial Sequence
  Synthetic construct: hsa-miR-147a
guguguggaaaugcuucugc

SEQ ID NO: 405 - RNA, 20 nt, Artificial Sequence
  Synthetic construct: hsa-miR-147a
agaagcauuuccacacacuu

SEQ ID NO: 406 - RNA, 22 nt, Artificial Sequence
  Synthetic construct: hsa-miR-147b
gugugcggaaaugcuucugcua

SEQ ID NO: 407 - RNA, 22 nt, Artificial Sequence
  Synthetic construct: hsa-miR-147b
gcagaagcauuuccgcacacuu

SEQ ID NO: 408 - RNA, 22 nt, Artificial Sequence
  Synthetic construct: hsa-miR-148a
aaaguucugagacacuccgacu

SEQ ID NO: 409 - RNA, 22 nt, Artificial Sequence
  Synthetic construct: hsa-miR-148a
ucagugcacuacagaacuuugu

SEQ ID NO: 410 - RNA, 22 nt, Artificial Sequence
  Synthetic construct: hsa-miR-148b
aaguucuguuauacacucaggc

SEQ ID NO: 411 - RNA, 22 nt, Artificial Sequence
  Synthetic construct: hsa-miR-148b
ucagugcaucacagaacuuugu

SEQ ID NO: 412 - RNA, 21 nt, Artificial Sequence
  Synthetic construct: hsa-miR-149
agggagggacgggggcugugc

SEQ ID NO: 413 - RNA, 23 nt, Artificial Sequence
  Synthetic construct: hsa-miR-149
ucuggcuccgugucuucacuccc

SEQ ID NO: 414 - RNA, 22 nt, Artificial Sequence
  Synthetic construct: hsa-miR-150
cugguacaggccugggggacag

SEQ ID NO: 415 - RNA, 22 nt, Artificial Sequence
  Synthetic construct: hsa-miR-150
ucucccaacccuuguaccagug

SEQ ID NO: 416 - RNA, 21 nt, Artificial Sequence
  Synthetic construct: hsa-miR-151a
ucgaggagcucacagucuagu

SEQ ID NO: 417 - RNA, 21 nt, Artificial Sequence
  Synthetic construct: hsa-miR-151a
cuagacugaagcuccuugagg

SEQ ID NO: 418 - RNA, 18 nt, Artificial Sequence
  Synthetic construct: hsa-miR-151b
ucgaggagcucacagucu

SEQ ID NO: 419 - RNA, 18 nt, Artificial Sequence
  Synthetic construct: hsa-miR-151b
acugugagcuccucgauu

SEQ ID NO: 420 - RNA, 23 nt, Artificial Sequence
  Synthetic construct: hsa-miR-152
agguucugugauacacuccgacu

SEQ ID NO: 421 - RNA, 21 nt, Artificial Sequence
  Synthetic construct: hsa-miR-152
ucagugcaugacagaacuugg

SEQ ID NO: 422 - RNA, 22 nt, Artificial Sequence
  Synthetic construct: hsa-miR-153
ucauuuuugugauguugcagcu

SEQ ID NO: 423 - RNA, 22 nt, Artificial Sequence
  Synthetic construct: hsa-miR-153
uugcauagucacaaaagugauc

SEQ ID NO: 424 - RNA, 22 nt, Artificial Sequence
  Synthetic construct: hsa-miR-1537
agcuguaauuagucaguuuucu

SEQ ID NO: 425 - RNA, 22 nt, Artificial Sequence
  Synthetic construct: hsa-miR-1537
aaaaccgucuaguuacaguugu

SEQ ID NO: 426 - RNA, 23 nt, Artificial Sequence
  Synthetic construct: hsa-miR-1538
cggcccgggcugcugcuguuccu

SEQ ID NO: 427 - RNA, 23 nt, Artificial Sequence
  Synthetic construct: hsa-miR-1538
gaacagcagcagcccgggccguu

SEQ ID NO: 428 - RNA, 21 nt, Artificial Sequence
  Synthetic construct: hsa-miR-1539
uccugcgcgucccagaugccc

SEQ ID NO: 429 - RNA, 21 nt, Artificial Sequence
  Synthetic construct: hsa-miR-1539
gcaucugggacgcgcaggauu

SEQ ID NO: 430 - RNA, 22 nt, Artificial Sequence
  Synthetic construct: hsa-miR-154
aaucauacacgguugaccuauu

SEQ ID NO: 431 - RNA, 22 nt, Artificial Sequence
  Synthetic construct: hsa-miR-154
uagguuauccguguugccuucg

SEQ ID NO: 432 - RNA, 22 nt, Artificial Sequence
  Synthetic construct: hsa-miR-155
cuccuacauauuagcauuaaca

SEQ ID NO: 433 - RNA, 23 nt, Artificial Sequence
  Synthetic construct: hsa-miR-155
uuaaugcuaaucgugauaggggu

SEQ ID NO: 434 - RNA, 20 nt, Artificial Sequence
  Synthetic construct: hsa-miR-1587
uugggcugggcuggguuggg

SEQ ID NO: 435 - RNA, 20 nt, Artificial Sequence
  Synthetic construct: hsa-miR-1587
caacccagcccagcccaauu

SEQ ID NO: 436 - RNA, 22 nt, Artificial Sequence
  Synthetic construct: hsa-miR-15a
caggccauauugugcugccuca

SEQ ID NO: 437 - RNA, 22 nt, Artificial Sequence
  Synthetic construct: hsa-miR-15a
uagcagcacauaaugguuugug

SEQ ID NO: 438 - RNA, 22 nt, Artificial Sequence
  Synthetic construct: hsa-miR-15b
cgaaucauuauuugcugcucua

SEQ ID NO: 439 - RNA, 22 nt, Artificial Sequence
  Synthetic construct: hsa-miR-15b
uagcagcacaucaugguuuaca

SEQ ID NO: 440 - RNA, 22 nt, Artificial Sequence
  Synthetic construct: hsa-miR-16-1
uagcagcacguaaauauuggcg

SEQ ID NO: 441 - RNA, 22 nt, Artificial Sequence
  Synthetic construct: hsa-miR-16-1
ccaguauuaacugugcugcuga

SEQ ID NO: 442 - RNA, 22 nt, Artificial Sequence
  Synthetic construct: hsa-miR-16-2
uagcagcacguaaauauuggcg

SEQ ID NO: 443 - RNA, 22 nt, Artificial Sequence
  Synthetic construct: hsa-miR-16-2
ccaauauuacugugcugcuuua

SEQ ID NO: 444 - RNA, 22 nt, Artificial Sequence
  Synthetic construct: hsa-miR-17
acugcagugaaggcacuuguag

SEQ ID NO: 445 - RNA, 23 nt, Artificial Sequence
  Synthetic construct: hsa-miR-17
caaagugcuuacagugcagguag

SEQ ID NO: 446 - RNA, 23 nt, Artificial Sequence
  Synthetic construct: hsa-miR-181a-1
aacauucaacgcugucggugagu

SEQ ID NO: 447 - RNA, 22 nt, Artificial Sequence
  Synthetic construct: hsa-miR-181a-1
accaucgaccguugauuguacc

SEQ ID NO: 448 - RNA, 23 nt, Artificial Sequence
  Synthetic construct: hsa-miR-181a-2
aacauucaacgcugucggugagu

SEQ ID NO: 449 - RNA, 22 nt, Artificial Sequence
  Synthetic construct: hsa-miR-181a-2
accacugaccguugacuguacc

SEQ ID NO: 450 - RNA, 23 nt, Artificial Sequence
  Synthetic construct: hsa-miR-181b-1
aacauucauugcugucggugggu

SEQ ID NO: 451 - RNA, 21 nt, Artificial Sequence
  Synthetic construct: hsa-miR-181b-1
cucacugaacaaugaaugcaa

SEQ ID NO: 452 - RNA, 23 nt, Artificial Sequence
  Synthetic construct: hsa-miR-181b-2
aacauucauugcugucggugggu

SEQ ID NO: 453 - RNA, 20 nt, Artificial Sequence
  Synthetic construct: hsa-miR-181b-2
cucacugaucaaugaaugca

SEQ ID NO: 454 - RNA, 22 nt, Artificial Sequence
  Synthetic construct: hsa-miR-181c
aaccaucgaccguugaguggac

SEQ ID NO: 455 - RNA, 22 nt, Artificial Sequence
  Synthetic construct: hsa-miR-181c
aacauucaaccugucggugagu

SEQ ID NO: 456 - RNA, 21 nt, Artificial Sequence
  Synthetic construct: hsa-miR-181d
ccaccgggggaugaaugucac

SEQ ID NO: 457 - RNA, 23 nt, Artificial Sequence
  Synthetic construct: hsa-miR-181d
aacauucauuguugucggugggu

SEQ ID NO: 458 - RNA, 24 nt, Artificial Sequence
  Synthetic construct: hsa-miR-182
uuuggcaaugguagaacucacacu

SEQ ID NO: 459 - RNA, 21 nt, Artificial Sequence
  Synthetic construct: hsa-miR-182
ugguucuagacuugccaacua

SEQ ID NO: 460 - RNA, 18 nt, Artificial Sequence
  Synthetic construct: hsa-miR-1825
uccagugcccuccucucc

SEQ ID NO: 461 - RNA, 18 nt, Artificial Sequence
  Synthetic construct: hsa-miR-1825
agaggagggcacuggauu

SEQ ID NO: 462 - RNA, 18 nt, Artificial Sequence
  Synthetic construct: hsa-miR-1827
ugaggcaguagauugaau

SEQ ID NO: 463 - RNA, 18 nt, Artificial Sequence
  Synthetic construct: hsa-miR-1827
ucaaucuacugccucauu

SEQ ID NO: 464 - RNA, 22 nt, Artificial Sequence
  Synthetic construct: hsa-miR-183
uauggcacugguagaauucacu

SEQ ID NO: 465 - RNA, 22 nt, Artificial Sequence
  Synthetic construct: hsa-miR-183
gugaauuaccgaagggccauaa

SEQ ID NO: 466 - RNA, 22 nt, Artificial Sequence
  Synthetic construct: hsa-miR-184
uggacggagaacugauaagggu

SEQ ID NO: 467 - RNA, 22 nt, Artificial Sequence
  Synthetic construct: hsa-miR-184
ccuuaucaguucuccguccauu

SEQ ID NO: 468 - RNA, 22 nt, Artificial Sequence
  Synthetic construct: hsa-miR-185
aggggcuggcuuuccucugguc

SEQ ID NO: 469 - RNA, 22 nt, Artificial Sequence
  Synthetic construct: hsa-miR-185
uggagagaaaggcaguuccuga

SEQ ID NO: 470 - RNA, 22 nt, Artificial Sequence
  Synthetic construct: hsa-miR-186
caaagaauucuccuuuugggcu

SEQ ID NO: 471 - RNA, 22 nt, Artificial Sequence
  Synthetic construct: hsa-miR-186
gcccaaaggugaauuuuuuggg

SEQ ID NO: 472 - RNA, 22 nt, Artificial Sequence
  Synthetic construct: hsa-miR-187
ucgugucuuguguugcagccgg

SEQ ID NO: 473 - RNA, 22 nt, Artificial Sequence
  Synthetic construct: hsa-miR-187
ggcuacaacacaggacccgggc

SEQ ID NO: 474 - RNA, 21 nt, Artificial Sequence
  Synthetic construct: hsa-miR-188
caucccuugcaugguggaggg

SEQ ID NO: 475 - RNA, 21 nt, Artificial Sequence
  Synthetic construct: hsa-miR-188
cucccacaugcaggguuugca

SEQ ID NO: 476 - RNA, 23 nt, Artificial Sequence
  Synthetic construct: hsa-miR-18a
uaaggugcaucuagugcagauag

SEQ ID NO: 477 - RNA, 23 nt, Artificial Sequence
  Synthetic construct: hsa-miR-18a
acugcccuaagugcuccuucugg

SEQ ID NO: 478 - RNA, 23 nt, Artificial Sequence
  Synthetic construct: hsa-miR-18b
uaaggugcaucuagugcaguuag

SEQ ID NO: 479 - RNA, 22 nt, Artificial Sequence
  Synthetic construct: hsa-miR-18b
ugcccuaaaugccccuucuggc

SEQ ID NO: 480 - RNA, 21 nt, Artificial Sequence
  Synthetic construct: hsa-miR-1908
cggcggggacggcgauugguc

SEQ ID NO: 481 - RNA, 21 nt, Artificial Sequence
  Synthetic construct: hsa-miR-1908
ccggccgccggcuccgccccg

SEQ ID NO: 482 - RNA, 22 nt, Artificial Sequence
  Synthetic construct: hsa-miR-1909
cgcaggggccgggugcucaccg

SEQ ID NO: 483 - RNA, 21 nt, Artificial Sequence
  Synthetic construct: hsa-miR-1909
ugagugccggugccugcccug

SEQ ID NO: 484 - RNA, 22 nt, Artificial Sequence
  Synthetic construct: hsa-miR-190a
ugauauguuugauauauuaggu

SEQ ID NO: 485 - RNA, 21 nt, Artificial Sequence
  Synthetic construct: hsa-miR-190a
cuauauaucaaacauauuccu

SEQ ID NO: 486 - RNA, 21 nt, Artificial Sequence
  Synthetic construct: hsa-miR-190b
ugauauguuugauauuggguu

SEQ ID NO: 487 - RNA, 21 nt, Artificial Sequence
  Synthetic construct: hsa-miR-190b
cccaauaucaaacauaucauu

SEQ ID NO: 488 - RNA, 22 nt, Artificial Sequence
  Synthetic construct: hsa-miR-191
gcugcgcuuggauuucgucccc

SEQ ID NO: 489 - RNA, 23 nt, Artificial Sequence
  Synthetic construct: hsa-miR-191
caacggaaucccaaaagcagcug

SEQ ID NO: 490 - RNA, 21 nt, Artificial Sequence
  Synthetic construct: hsa-miR-1910
ccaguccugugccugccgccu

SEQ ID NO: 491 - RNA, 20 nt, Artificial Sequence
  Synthetic construct: hsa-miR-1910
gaggcagaagcaggaugaca

SEQ ID NO: 492 - RNA, 20 nt, Artificial Sequence
  Synthetic construct: hsa-miR-1911
caccaggcauuguggucucc

SEQ ID NO: 493 - RNA, 23 nt, Artificial Sequence
  Synthetic construct: hsa-miR-1911
ugaguaccgccaugucuguuggg

SEQ ID NO: 494 - RNA, 22 nt, Artificial Sequence
  Synthetic construct: hsa-miR-1912
uacccagagcaugcagugugaa

SEQ ID NO: 495 - RNA, 22 nt, Artificial Sequence
  Synthetic construct: hsa-miR-1912
cacacugcaugcucuggguauu

SEQ ID NO: 496 - RNA, 22 nt, Artificial Sequence
  Synthetic construct: hsa-miR-1913
ucugcccccuccgcugcugcca

SEQ ID NO: 497 - RNA, 22 nt, Artificial Sequence
  Synthetic construct: hsa-miR-1913
gcagcagcggagggggcagauu

SEQ ID NO: 498 - RNA, 22 nt, Artificial Sequence
  Synthetic construct: hsa-miR-1914
cccugugcccggcccacuucug

SEQ ID NO: 499 - RNA, 22 nt, Artificial Sequence
  Synthetic construct: hsa-miR-1914
ggaggggucccgcacugggagg

SEQ ID NO: 500 - RNA, 22 nt, Artificial Sequence
  Synthetic construct: hsa-miR-1915
accuugccuugcugcccgggcc

SEQ ID NO: 501 - RNA, 20 nt, Artificial Sequence
  Synthetic construct: hsa-miR-1915
ccccagggcgacgcggcggg

SEQ ID NO: 502 - RNA, 22 nt, Artificial Sequence
  Synthetic construct: hsa-miR-192
cugccaauuccauaggucacag

SEQ ID NO: 503 - RNA, 21 nt, Artificial Sequence
  Synthetic construct: hsa-miR-192
cugaccuaugaauugacagcc

SEQ ID NO: 504 - RNA, 22 nt, Artificial Sequence
  Synthetic construct: hsa-miR-193a
ugggucuuugcgggcgagauga

SEQ ID NO: 505 - RNA, 22 nt, Artificial Sequence
  Synthetic construct: hsa-miR-193a
aacuggccuacaaagucccagu

SEQ ID NO: 506 - RNA, 22 nt, Artificial Sequence
  Synthetic construct: hsa-miR-193b
cgggguuuugagggcgagauga

SEQ ID NO: 507 - RNA, 22 nt, Artificial Sequence
  Synthetic construct: hsa-miR-193b
aacuggcccucaaagucccgcu

SEQ ID NO: 508 - RNA, 22 nt, Artificial Sequence
  Synthetic construct: hsa-miR-194
uguaacagcaacuccaugugga

SEQ ID NO: 509 - RNA, 22 nt, Artificial Sequence
  Synthetic construct: hsa-miR-194
ccaguggggcugcuguuaucug

SEQ ID NO: 510 - RNA, 21 nt, Artificial Sequence
  Synthetic construct: hsa-miR-195
uagcagcacagaaauauuggc

SEQ ID NO: 511 - RNA, 22 nt, Artificial Sequence
  Synthetic construct: hsa-miR-195
ccaauauuggcugugcugcucc

SEQ ID NO: 512 - RNA, 22 nt, Artificial Sequence
  Synthetic construct: hsa-miR-196a
uagguaguuucauguuguuggg

SEQ ID NO: 513 - RNA, 22 nt, Artificial Sequence
  Synthetic construct: hsa-miR-196a
cggcaacaagaaacugccugag

SEQ ID NO: 514 - RNA, 22 nt, Artificial Sequence
  Synthetic construct: hsa-miR-196b
ucgacagcacgacacugccuuc

SEQ ID NO: 515 - RNA, 22 nt, Artificial Sequence
  Synthetic construct: hsa-miR-196b
uagguaguuuccuguuguuggg

SEQ ID NO: 516 - RNA, 23 nt, Artificial Sequence
  Synthetic construct: hsa-miR-197
cggguagagagggcagugggagg

SEQ ID NO: 517 - RNA, 22 nt, Artificial Sequence
  Synthetic construct: hsa-miR-197
uucaccaccuucuccacccagc

SEQ ID NO: 518 - RNA, 22 nt, Artificial Sequence
  Synthetic construct: hsa-miR-1972
ucaggccaggcacaguggcuca

SEQ ID NO: 519 - RNA, 22 nt, Artificial Sequence
  Synthetic construct: hsa-miR-1972
agccacugugccuggccugauu

SEQ ID NO: 520 - RNA, 19 nt, Artificial Sequence
  Synthetic construct: hsa-miR-1973
accgugcaaagguagcaua

SEQ ID NO: 521 - RNA, 19 nt, Artificial Sequence
  Synthetic construct: hsa-miR-1973
ugcuaccuuugcacgguuu

SEQ ID NO: 522 - RNA, 20 nt, Artificial Sequence
  Synthetic construct: hsa-miR-1976
ccuccugcccuccuugcugu

SEQ ID NO: 523 - RNA, 20 nt, Artificial Sequence
  Synthetic construct: hsa-miR-1976
agcaaggagggcaggagguu

SEQ ID NO: 524 - RNA, 22 nt, Artificial Sequence
  Synthetic construct: hsa-miR-198
gguccagaggggagauagguuc

SEQ ID NO: 525 - RNA, 22 nt, Artificial Sequence
  Synthetic construct: hsa-miR-198
accuaucuccccucuggaccuu

SEQ ID NO: 526 - RNA, 22 nt, Artificial Sequence
  Synthetic construct: hsa-miR-199a
acaguagucugcacauugguua

SEQ ID NO: 527 - RNA, 23 nt, Artificial Sequence
  Synthetic construct: hsa-miR-199a
cccaguguucagacuaccuguuc

SEQ ID NO: 528 - RNA, 23 nt, Artificial Sequence
  Synthetic construct: hsa-miR-199b
cccaguguuuagacuaucuguuc

SEQ ID NO: 529 - RNA, 22 nt, Artificial Sequence
  Synthetic construct: hsa-miR-199b
acaguagucugcacauugguua

SEQ ID NO: 530 - RNA, 23 nt, Artificial Sequence
  Synthetic construct: hsa-miR-19a
ugugcaaaucuaugcaaaacuga

SEQ ID NO: 531 - RNA, 22 nt, Artificial Sequence
  Synthetic construct: hsa-miR-19a
aguuuugcauaguugcacuaca

SEQ ID NO: 532 - RNA, 23 nt, Artificial Sequence
  Synthetic construct: hsa-miR-19b-1
ugugcaaauccaugcaaaacuga

SEQ ID NO: 533 - RNA, 23 nt, Artificial Sequence
  Synthetic construct: hsa-miR-19b-1
aguuuugcagguuugcauccagc

SEQ ID NO: 534 - RNA, 23 nt, Artificial Sequence
  Synthetic construct: hsa-miR-19b-2
ugugcaaauccaugcaaaacuga

SEQ ID NO: 535 - RNA, 22 nt, Artificial Sequence
  Synthetic construct: hsa-miR-19b-2
aguuuugcagguuugcauuuca

SEQ ID NO: 536 - RNA, 22 nt, Artificial Sequence
  Synthetic construct: hsa-miR-200a
uaacacugucugguaacgaugu

SEQ ID NO: 537 - RNA, 22 nt, Artificial Sequence
  Synthetic construct: hsa-miR-200a
caucuuaccggacagugcugga

SEQ ID NO: 538 - RNA, 22 nt, Artificial Sequence
  Synthetic construct: hsa-miR-200b
caucuuacugggcagcauugga

SEQ ID NO: 539 - RNA, 22 nt, Artificial Sequence
  Synthetic construct: hsa-miR-200b
uaauacugccugguaaugauga

SEQ ID NO: 540 - RNA, 23 nt, Artificial Sequence
  Synthetic construct: hsa-miR-200c
uaauacugccggguaaugaugga

SEQ ID NO: 541 - RNA, 22 nt, Artificial Sequence
  Synthetic construct: hsa-miR-200c
cgucuuacccagcaguguuugg

SEQ ID NO: 542 - RNA, 22 nt, Artificial Sequence
  Synthetic construct: hsa-miR-202
uuccuaugcauauacuucuuug

SEQ ID NO: 543 - RNA, 20 nt, Artificial Sequence
  Synthetic construct: hsa-miR-202
agagguauagggcaugggaa

SEQ ID NO: 544 - RNA, 25 nt, Artificial Sequence
  Synthetic construct: hsa-miR-203a
agugguucuuaacaguucaacaguu

SEQ ID NO: 545 - RNA, 22 nt, Artificial Sequence
  Synthetic construct: hsa-miR-203a
gugaaauguuuaggaccacuag

SEQ ID NO: 546 - RNA, 22 nt, Artificial Sequence
  Synthetic construct: hsa-miR-203b
uagugguccuaaacauuucaca

SEQ ID NO: 547 - RNA, 23 nt, Artificial Sequence
  Synthetic construct: hsa-miR-203b
uugaacuguuaagaaccacugga

SEQ ID NO: 548 - RNA, 21 nt, Artificial Sequence
  Synthetic construct: hsa-miR-204
gcugggaaggcaaagggacgu

SEQ ID NO: 549 - RNA, 22 nt, Artificial Sequence
  Synthetic construct: hsa-miR-204
uucccuuugucauccuaugccu

SEQ ID NO: 550 - RNA, 22 nt, Artificial Sequence
  Synthetic construct: hsa-miR-205
uccuucauuccaccggagucug

SEQ ID NO: 551 - RNA, 21 nt, Artificial Sequence
  Synthetic construct: hsa-miR-205
gauuucaguggagugaaguuc

SEQ ID NO: 552 - RNA, 20 nt, Artificial Sequence
  Synthetic construct: hsa-miR-2052
uguuuugauaacaguaaugu

SEQ ID NO: 553 - RNA, 20 nt, Artificial Sequence
  Synthetic construct: hsa-miR-2052
auuacuguuaucaaaacauu

SEQ ID NO: 554 - RNA, 23 nt, Artificial Sequence
  Synthetic construct: hsa-miR-2053
guguuaauuaaaccucuauuuac

SEQ ID NO: 555 - RNA, 23 nt, Artificial Sequence
  Synthetic construct: hsa-miR-2053
aaauagagguuuaauuaacacuu

SEQ ID NO: 556 - RNA, 23 nt, Artificial Sequence
  Synthetic construct: hsa-miR-2054
cuguaauauaaauuuaauuuauu

SEQ ID NO: 557 - RNA, 23 nt, Artificial Sequence
  Synthetic construct: hsa-miR-2054
uaaauuaaauuuauauuacaguu

SEQ ID NO: 558 - RNA, 22 nt, Artificial Sequence
  Synthetic construct: hsa-miR-206
uggaauguaaggaagugugugg

SEQ ID NO: 559 - RNA, 22 nt, Artificial Sequence
  Synthetic construct: hsa-miR-206
acacacuuccuuacauuccauu

SEQ ID NO: 560 - RNA, 22 nt, Artificial Sequence
  Synthetic construct: hsa-miR-208a
auaagacgagcaaaaagcuugu

SEQ ID NO: 561 - RNA, 22 nt, Artificial Sequence
  Synthetic construct: hsa-miR-208a
gagcuuuuggcccggguuauac

SEQ ID NO: 562 - RNA, 22 nt, Artificial Sequence
  Synthetic construct: hsa-miR-208b
aagcuuuuugcucgaauuaugu

SEQ ID NO: 563 - RNA, 22 nt, Artificial Sequence
  Synthetic construct: hsa-miR-208b
auaagacgaacaaaagguuugu

SEQ ID NO: 564 - RNA, 23 nt, Artificial Sequence
  Synthetic construct: hsa-miR-20a
uaaagugcuuauagugcagguag

SEQ ID NO: 565 - RNA, 22 nt, Artificial Sequence
  Synthetic construct: hsa-miR-20a
acugcauuaugagcacuuaaag

SEQ ID NO: 566 - RNA, 23 nt, Artificial Sequence
  Synthetic construct: hsa-miR-20b
caaagugcucauagugcagguag

SEQ ID NO: 567 - RNA, 22 nt, Artificial Sequence
  Synthetic construct: hsa-miR-20b
acuguaguaugggcacuuccag

SEQ ID NO: 568 - RNA, 22 nt, Artificial Sequence
  Synthetic construct: hsa-miR-21
uagcuuaucagacugauguuga

SEQ ID NO: 569 - RNA, 21 nt, Artificial Sequence
  Synthetic construct: hsa-miR-21
caacaccagucgaugggcugu

SEQ ID NO: 570 - RNA, 22 nt, Artificial Sequence
  Synthetic construct: hsa-miR-210
agccccugcccaccgcacacug

SEQ ID NO: 571 - RNA, 22 nt, Artificial Sequence
  Synthetic construct: hsa-miR-210
cugugcgugugacagcggcuga

SEQ ID NO: 572 - RNA, 21 nt, Artificial Sequence
  Synthetic construct: hsa-miR-211
gcagggacagcaaaggggugc

SEQ ID NO: 573 - RNA, 22 nt, Artificial Sequence
  Synthetic construct: hsa-miR-211
uucccuuugucauccuucgccu

SEQ ID NO: 574 - RNA, 22 nt, Artificial Sequence
  Synthetic construct: hsa-miR-2110
uuggggaaacggccgcugagug

SEQ ID NO: 575 - RNA, 22 nt, Artificial Sequence
  Synthetic construct: hsa-miR-2110
cucagcggccguuuccccaauu

SEQ ID NO: 576 - RNA, 21 nt, Artificial Sequence
  Synthetic construct: hsa-miR-2113
auuugugcuuggcucugucac

SEQ ID NO: 577 - RNA, 21 nt, Artificial Sequence
  Synthetic construct: hsa-miR-2113
gacagagccaagcacaaauuu

SEQ ID NO: 578 - RNA, 22 nt, Artificial Sequence
  Synthetic construct: hsa-miR-2114
uagucccuuccuugaagcgguc

SEQ ID NO: 579 - RNA, 21 nt, Artificial Sequence
  Synthetic construct: hsa-miR-2114
cgagccucaagcaagggacuu

SEQ ID NO: 580 - RNA, 22 nt, Artificial Sequence
  Synthetic construct: hsa-miR-2115
caucagaauucauggaggcuag

SEQ ID NO: 581 - RNA, 22 nt, Artificial Sequence
  Synthetic construct: hsa-miR-2115
agcuuccaugacuccugaugga

SEQ ID NO: 582 - RNA, 21 nt, Artificial Sequence
  Synthetic construct: hsa-miR-2116
gguucuuagcauaggaggucu

SEQ ID NO: 583 - RNA, 21 nt, Artificial Sequence
  Synthetic construct: hsa-miR-2116
ccucccaugccaagaacuccc

SEQ ID NO: 584 - RNA, 21 nt, Artificial Sequence
  Synthetic construct: hsa-miR-2117
uguucucuuugccaaggacag

SEQ ID NO: 585 - RNA, 21 nt, Artificial Sequence
  Synthetic construct: hsa-miR-2117
guccuuggcaaagagaacauu

SEQ ID NO: 586 - RNA, 21 nt, Artificial Sequence
  Synthetic construct: hsa-miR-212
uaacagucuccagucacggcc

SEQ ID NO: 587 - RNA, 23 nt, Artificial Sequence
  Synthetic construct: hsa-miR-212
accuuggcucuagacugcuuacu

SEQ ID NO: 588 - RNA, 22 nt, Artificial Sequence
  Synthetic construct: hsa-miR-214
ugccugucuacacuugcugugc

SEQ ID NO: 589 - RNA, 22 nt, Artificial Sequence
  Synthetic construct: hsa-miR-214
acagcaggcacagacaggcagu

SEQ ID NO: 590 - RNA, 23 nt, Artificial Sequence
  Synthetic construct: hsa-miR-215
ucugucauuucuuuaggccaaua

SEQ ID NO: 591 - RNA, 21 nt, Artificial Sequence
  Synthetic construct: hsa-miR-215
augaccuaugaauugacagac

SEQ ID NO: 592 - RNA, 22 nt, Artificial Sequence
  Synthetic construct: hsa-miR-216a
uaaucucagcuggcaacuguga

SEQ ID NO: 593 - RNA, 22 nt, Artificial Sequence
  Synthetic construct: hsa-miR-216a
ucacaguggucucugggauuau

SEQ ID NO: 594 - RNA, 22 nt, Artificial Sequence
  Synthetic construct: hsa-miR-216b
aaaucucugcaggcaaauguga

SEQ ID NO: 595 - RNA, 24 nt, Artificial Sequence
  Synthetic construct: hsa-miR-216b
acacacuuacccguagagauucua

SEQ ID NO: 596 - RNA, 23 nt, Artificial Sequence
  Synthetic construct: hsa-miR-217
uacugcaucaggaacugauugga

SEQ ID NO: 597 - RNA, 23 nt, Artificial Sequence
  Synthetic construct: hsa-miR-217
caaucaguuccugaugcaguauu

SEQ ID NO: 598 - RNA, 21 nt, Artificial Sequence
  Synthetic construct: hsa-miR-218-1
uugugcuugaucuaaccaugu

SEQ ID NO: 599 - RNA, 22 nt, Artificial Sequence
  Synthetic construct: hsa-miR-218-1
augguuccgucaagcaccaugg

SEQ ID NO: 600 - RNA, 21 nt, Artificial Sequence
  Synthetic construct: hsa-miR-218-2
uugugcuugaucuaaccaugu

SEQ ID NO: 601 - RNA, 22 nt, Artificial Sequence
  Synthetic construct: hsa-miR-218-2
caugguucugucaagcaccgcg

SEQ ID NO: 602 - RNA, 21 nt, Artificial Sequence
  Synthetic construct: hsa-miR-219a-1
ugauuguccaaacgcaauucu

SEQ ID NO: 603 - RNA, 22 nt, Artificial Sequence
  Synthetic construct: hsa-miR-219a-1
agaguugagucuggacgucccg

SEQ ID NO: 604 - RNA, 21 nt, Artificial Sequence
  Synthetic construct: hsa-miR-219a-2
ugauuguccaaacgcaauucu

SEQ ID NO: 605 - RNA, 22 nt, Artificial Sequence
  Synthetic construct: hsa-miR-219a-2
agaauuguggcuggacaucugu

SEQ ID NO: 606 - RNA, 22 nt, Artificial Sequence
  Synthetic construct: hsa-miR-219b
agauguccagccacaauucucg

SEQ ID NO: 607 - RNA, 23 nt, Artificial Sequence
  Synthetic construct: hsa-miR-219b
agaauugcguuuggacaaucagu

SEQ ID NO: 608 - RNA, 22 nt, Artificial Sequence
  Synthetic construct: hsa-miR-22
aguucuucaguggcaagcuuua

SEQ ID NO: 609 - RNA, 22 nt, Artificial Sequence
  Synthetic construct: hsa-miR-22
aagcugccaguugaagaacugu

SEQ ID NO: 610 - RNA, 23 nt, Artificial Sequence
  Synthetic construct: hsa-miR-221
agcuacauugucugcuggguuuc

SEQ ID NO: 611 - RNA, 22 nt, Artificial Sequence
  Synthetic construct: hsa-miR-221
accuggcauacaauguagauuu

SEQ ID NO: 612 - RNA, 21 nt, Artificial Sequence
  Synthetic construct: hsa-miR-222
agcuacaucuggcuacugggu

SEQ ID NO: 613 - RNA, 22 nt, Artificial Sequence
  Synthetic construct: hsa-miR-222
cucaguagccaguguagauccu

SEQ ID NO: 614 - RNA, 22 nt, Artificial Sequence
  Synthetic construct: hsa-miR-223
cguguauuugacaagcugaguu

SEQ ID NO: 615 - RNA, 22 nt, Artificial Sequence
  Synthetic construct: hsa-miR-223
ugucaguuugucaaauacccca

SEQ ID NO: 616 - RNA, 23 nt, Artificial Sequence
  Synthetic construct: hsa-miR-224
aaaauggugcccuagugacuaca

SEQ ID NO: 617 - RNA, 21 nt, Artificial Sequence
  Synthetic construct: hsa-miR-224
caagucacuagugguuccguu

SEQ ID NO: 618 - RNA, 22 nt, Artificial Sequence
  Synthetic construct: hsa-miR-2276
gcccucugucaccuugcagacg

SEQ ID NO: 619 - RNA, 22 nt, Artificial Sequence
  Synthetic construct: hsa-miR-2276
ucugcaagugucagaggcgagg

SEQ ID NO: 620 - RNA, 24 nt, Artificial Sequence
  Synthetic construct: hsa-miR-2277
agcgcgggcugagcgcugccaguc

SEQ ID NO: 621 - RNA, 21 nt, Artificial Sequence
  Synthetic construct: hsa-miR-2277
ugacagcgcccugccuggcuc

SEQ ID NO: 622 - RNA, 22 nt, Artificial Sequence
  Synthetic construct: hsa-miR-2278
gagagcaguguguguugccugg

SEQ ID NO: 623 - RNA, 22 nt, Artificial Sequence
  Synthetic construct: hsa-miR-2278
aggcaacacacacugcucucuu

SEQ ID NO: 624 - RNA, 21 nt, Artificial Sequence
  Synthetic construct: hsa-miR-2355
auccccagauacaauggacaa

SEQ ID NO: 625 - RNA, 22 nt, Artificial Sequence
  Synthetic construct: hsa-miR-2355
auuguccuugcuguuuggagau

SEQ ID NO: 626 - RNA, 20 nt, Artificial Sequence
  Synthetic construct: hsa-miR-2392
uaggaugggggugagaggug

SEQ ID NO: 627 - RNA, 20 nt, Artificial Sequence
  Synthetic construct: hsa-miR-2392
ccucucacccccauccuauu

SEQ ID NO: 628 - RNA, 21 nt, Artificial Sequence
  Synthetic construct: hsa-miR-23a
aucacauugccagggauuucc

SEQ ID NO: 629 - RNA, 22 nt, Artificial Sequence
  Synthetic construct: hsa-miR-23a
gggguuccuggggaugggauuu

SEQ ID NO: 630 - RNA, 21 nt, Artificial Sequence
  Synthetic construct: hsa-miR-23b
aucacauugccagggauuacc

SEQ ID NO: 631 - RNA, 22 nt, Artificial Sequence
  Synthetic construct: hsa-miR-23b
uggguuccuggcaugcugauuu

SEQ ID NO: 632 - RNA, 22 nt, Artificial Sequence
  Synthetic construct: hsa-miR-23c
aucacauugccagugauuaccc

SEQ ID NO: 633 - RNA, 22 nt, Artificial Sequence
  Synthetic construct: hsa-miR-23c
guaaucacuggcaaugugauuu

SEQ ID NO: 634 - RNA, 22 nt, Artificial Sequence
  Synthetic construct: hsa-miR-24-1
uggcucaguucagcaggaacag

SEQ ID NO: 635 - RNA, 22 nt, Artificial Sequence
  Synthetic construct: hsa-miR-24-1
ugccuacugagcugauaucagu

SEQ ID NO: 636 - RNA, 22 nt, Artificial Sequence
  Synthetic construct: hsa-miR-24-2
uggcucaguucagcaggaacag

SEQ ID NO: 637 - RNA, 22 nt, Artificial Sequence
  Synthetic construct: hsa-miR-24-2
ugccuacugagcugaaacacag

SEQ ID NO: 638 - RNA, 22 nt, Artificial Sequence
  Synthetic construct: hsa-miR-2467
agcagaggcagagaggcucagg

SEQ ID NO: 639 - RNA, 23 nt, Artificial Sequence
  Synthetic construct: hsa-miR-2467
ugaggcucuguuagccuuggcuc

SEQ ID NO: 640 - RNA, 21 nt, Artificial Sequence
  Synthetic construct: hsa-miR-25
aggcggagacuugggcaauug

SEQ ID NO: 641 - RNA, 22 nt, Artificial Sequence
  Synthetic construct: hsa-miR-25
cauugcacuugucucggucuga

SEQ ID NO: 642 - RNA, 22 nt, Artificial Sequence
  Synthetic construct: hsa-miR-2681
guuuuaccaccuccaggagacu

SEQ ID NO: 643 - RNA, 22 nt, Artificial Sequence
  Synthetic construct: hsa-miR-2681
uaucauggaguugguaaagcac

SEQ ID NO: 644 - RNA, 22 nt, Artificial Sequence
  Synthetic construct: hsa-miR-2682
cgccucuucagcgcugucuucc

SEQ ID NO: 645 - RNA, 23 nt, Artificial Sequence
  Synthetic construct: hsa-miR-2682
caggcagugacuguucagacguc

SEQ ID NO: 646 - RNA, 22 nt, Artificial Sequence
  Synthetic construct: hsa-miR-26a-1
uucaaguaauccaggauaggcu

SEQ ID NO: 647 - RNA, 22 nt, Artificial Sequence
  Synthetic construct: hsa-miR-26a-1
ccuauucuugguuacuugcacg

SEQ ID NO: 648 - RNA, 22 nt, Artificial Sequence
  Synthetic construct: hsa-miR-26a-2
uucaaguaauccaggauaggcu

SEQ ID NO: 649 - RNA, 22 nt, Artificial Sequence
  Synthetic construct: hsa-miR-26a-2
ccuauucuugauuacuuguuuc

SEQ ID NO: 650 - RNA, 21 nt, Artificial Sequence
  Synthetic construct: hsa-miR-26b
uucaaguaauucaggauaggu

SEQ ID NO: 651 - RNA, 22 nt, Artificial Sequence
  Synthetic construct: hsa-miR-26b
ccuguucuccauuacuuggcuc

SEQ ID NO: 652 - RNA, 21 nt, Artificial Sequence
  Synthetic construct: hsa-miR-27a
uucacaguggcuaaguuccgc

SEQ ID NO: 653 - RNA, 22 nt, Artificial Sequence
  Synthetic construct: hsa-miR-27a
agggcuuagcugcuugugagca

SEQ ID NO: 654 - RNA, 21 nt, Artificial Sequence
  Synthetic construct: hsa-miR-27b
uucacaguggcuaaguucugc

SEQ ID NO: 655 - RNA, 22 nt, Artificial Sequence
  Synthetic construct: hsa-miR-27b
agagcuuagcugauuggugaac

SEQ ID NO: 656 - RNA, 22 nt, Artificial Sequence
  Synthetic construct: hsa-miR-28
cacuagauugugagcuccugga

SEQ ID NO: 657 - RNA, 22 nt, Artificial Sequence
  Synthetic construct: hsa-miR-28
aaggagcucacagucuauugag

SEQ ID NO: 658 - RNA, 19 nt, Artificial Sequence
  Synthetic construct: hsa-miR-2861
ggggccuggcggugggcgg

SEQ ID NO: 659 - RNA, 19 nt, Artificial Sequence
  Synthetic construct: hsa-miR-2861
gcccaccgccaggccccuu

SEQ ID NO: 660 - RNA, 21 nt, Artificial Sequence
  Synthetic construct: hsa-miR-2909
guuagggccaacaucucuugg

SEQ ID NO: 661 - RNA, 21 nt, Artificial Sequence
  Synthetic construct: hsa-miR-2909
aagagauguuggcccuaacuu

SEQ ID NO: 662 - RNA, 22 nt, Artificial Sequence
  Synthetic construct: hsa-miR-296
gaggguuggguggaggcucucc

SEQ ID NO: 663 - RNA, 21 nt, Artificial Sequence
  Synthetic construct: hsa-miR-296
agggcccccccucaauccugu

SEQ ID NO: 664 - RNA, 21 nt, Artificial Sequence
  Synthetic construct: hsa-miR-297
auguaugugugcaugugcaug

SEQ ID NO: 665 - RNA, 21 nt, Artificial Sequence
  Synthetic construct: hsa-miR-297
ugcacaugcacacauacauuu

SEQ ID NO: 666 - RNA, 24 nt, Artificial Sequence
  Synthetic construct: hsa-miR-298
agcagaagcagggagguucuccca

SEQ ID NO: 667 - RNA, 24 nt, Artificial Sequence
  Synthetic construct: hsa-miR-298
ggagaaccucccugcuucugcuuu

SEQ ID NO: 668 - RNA, 22 nt, Artificial Sequence
  Synthetic construct: hsa-miR-299
ugguuuaccgucccacauacau

SEQ ID NO: 669 - RNA, 22 nt, Artificial Sequence
  Synthetic construct: hsa-miR-299
uaugugggaugguaaaccgcuu

SEQ ID NO: 670 - RNA, 22 nt, Artificial Sequence
  Synthetic construct: hsa-miR-29a
acugauuucuuuugguguucag

SEQ ID NO: 671 - RNA, 22 nt, Artificial Sequence
  Synthetic construct: hsa-miR-29a
uagcaccaucugaaaucgguua

SEQ ID NO: 672 - RNA, 23 nt, Artificial Sequence
  Synthetic construct: hsa-miR-29b-1
uagcaccauuugaaaucaguguu

SEQ ID NO: 673 - RNA, 24 nt, Artificial Sequence
  Synthetic construct: hsa-miR-29b-1
gcugguuucauauggugguuuaga

SEQ ID NO: 674 - RNA, 23 nt, Artificial Sequence
  Synthetic construct: hsa-miR-29b-2
uagcaccauuugaaaucaguguu

SEQ ID NO: 675 - RNA, 22 nt, Artificial Sequence
  Synthetic construct: hsa-miR-29b-2
cugguuucacaugguggcuuag

SEQ ID NO: 676 - RNA, 22 nt, Artificial Sequence
  Synthetic construct: hsa-miR-29c
ugaccgauuucuccugguguuc

SEQ ID NO: 677 - RNA, 22 nt, Artificial Sequence
  Synthetic construct: hsa-miR-29c
uagcaccauuugaaaucgguua

SEQ ID NO: 678 - RNA, 22 nt, Artificial Sequence
  Synthetic construct: hsa-miR-300
uauacaagggcagacucucucu

SEQ ID NO: 679 - RNA, 22 nt, Artificial Sequence
  Synthetic construct: hsa-miR-300
agagagucugcccuuguauauu

SEQ ID NO: 680 - RNA, 22 nt, Artificial Sequence
  Synthetic construct: hsa-miR-301a
gcucugacuuuauugcacuacu

SEQ ID NO: 681 - RNA, 23 nt, Artificial Sequence
  Synthetic construct: hsa-miR-301a
cagugcaauaguauugucaaagc

SEQ ID NO: 682 - RNA, 23 nt, Artificial Sequence
  Synthetic construct: hsa-miR-301b
cagugcaaugauauugucaaagc

SEQ ID NO: 683 - RNA, 22 nt, Artificial Sequence
  Synthetic construct: hsa-miR-301b
gcucugacgagguugcacuacu

SEQ ID NO: 684 - RNA, 23 nt, Artificial Sequence
  Synthetic construct: hsa-miR-302a
uaagugcuuccauguuuugguga

SEQ ID NO: 685 - RNA, 23 nt, Artificial Sequence
  Synthetic construct: hsa-miR-302a
acuuaaacguggauguacuugcu

SEQ ID NO: 686 - RNA, 23 nt, Artificial Sequence
  Synthetic construct: hsa-miR-302b
uaagugcuuccauguuuuaguag

SEQ ID NO: 687 - RNA, 22 nt, Artificial Sequence
  Synthetic construct: hsa-miR-302b
acuuuaacauggaagugcuuuc

SEQ ID NO: 688 - RNA, 22 nt, Artificial Sequence
  Synthetic construct: hsa-miR-302c
uuuaacauggggguaccugcug

SEQ ID NO: 689 - RNA, 23 nt, Artificial Sequence
  Synthetic construct: hsa-miR-302c
uaagugcuuccauguuucagugg

SEQ ID NO: 690 - RNA, 22 nt, Artificial Sequence
  Synthetic construct: hsa-miR-302d
acuuuaacauggaggcacuugc

SEQ ID NO: 691 - RNA, 23 nt, Artificial Sequence
  Synthetic construct: hsa-miR-302d
uaagugcuuccauguuugagugu

SEQ ID NO: 692 - RNA, 17 nt, Artificial Sequence
  Synthetic construct: hsa-miR-302e
uaagugcuuccaugcuu

SEQ ID NO: 693 - RNA, 17 nt, Artificial Sequence
  Synthetic construct: hsa-miR-302e
gcauggaagcacuuauu

SEQ ID NO: 694 - RNA, 17 nt, Artificial Sequence
  Synthetic construct: hsa-miR-302f
uaauugcuuccauguuu

SEQ ID NO: 695 - RNA, 17 nt, Artificial Sequence
  Synthetic construct: hsa-miR-302f
acauggaagcaauuauu

SEQ ID NO: 696 - RNA, 23 nt, Artificial Sequence
  Synthetic construct: hsa-miR-3064
uugccacacugcaacaccuuaca

SEQ ID NO: 697 - RNA, 21 nt, Artificial Sequence
  Synthetic construct: hsa-miR-3064
ucuggcuguuguggugugcaa

SEQ ID NO: 698 - RNA, 23 nt, Artificial Sequence
  Synthetic construct: hsa-miR-3065
ucagcaccaggauauuguuggag

SEQ ID NO: 699 - RNA, 23 nt, Artificial Sequence
  Synthetic construct: hsa-miR-3065
ucaacaaaaucacugaugcugga

SEQ ID NO: 700 - RNA, 22 nt, Artificial Sequence
  Synthetic construct: hsa-miR-3074
gauaucagcucaguaggcaccg

SEQ ID NO: 701 - RNA, 21 nt, Artificial Sequence
  Synthetic construct: hsa-miR-3074
guuccugcugaacugagccag

SEQ ID NO: 702 - RNA, 22 nt, Artificial Sequence
  Synthetic construct: hsa-miR-30a
cuuucagucggauguuugcagc

SEQ ID NO: 703 - RNA, 22 nt, Artificial Sequence
  Synthetic construct: hsa-miR-30a
uguaaacauccucgacuggaag

SEQ ID NO: 704 - RNA, 22 nt, Artificial Sequence
  Synthetic construct: hsa-miR-30b
uguaaacauccuacacucagcu

SEQ ID NO: 705 - RNA, 22 nt, Artificial Sequence
  Synthetic construct: hsa-miR-30b
cugggagguggauguuuacuuc

SEQ ID NO: 706 - RNA, 23 nt, Artificial Sequence
  Synthetic construct: hsa-miR-30c-1
uguaaacauccuacacucucagc

SEQ ID NO: 707 - RNA, 22 nt, Artificial Sequence
  Synthetic construct: hsa-miR-30c-1
cugggagaggguuguuuacucc

SEQ ID NO: 708 - RNA, 23 nt, Artificial Sequence
  Synthetic construct: hsa-miR-30c-2
uguaaacauccuacacucucagc

SEQ ID NO: 709 - RNA, 22 nt, Artificial Sequence
  Synthetic construct: hsa-miR-30c-2
cugggagaaggcuguuuacucu

SEQ ID NO: 710 - RNA, 22 nt, Artificial Sequence
  Synthetic construct: hsa-miR-30d
uguaaacauccccgacuggaag

SEQ ID NO: 711 - RNA, 22 nt, Artificial Sequence
  Synthetic construct: hsa-miR-30d
cuuucagucagauguuugcugc

SEQ ID NO: 712 - RNA, 22 nt, Artificial Sequence
  Synthetic construct: hsa-miR-30e
uguaaacauccuugacuggaag

SEQ ID NO: 713 - RNA, 22 nt, Artificial Sequence
  Synthetic construct: hsa-miR-30e
cuuucagucggauguuuacagc

SEQ ID NO: 714 - RNA, 22 nt, Artificial Sequence
  Synthetic construct: hsa-miR-31
ugcuaugccaacauauugccau

SEQ ID NO: 715 - RNA, 21 nt, Artificial Sequence
  Synthetic construct: hsa-miR-31
aggcaagaugcuggcauagcu

SEQ ID NO: 716 - RNA, 20 nt, Artificial Sequence
  Synthetic construct: hsa-miR-3115
auauggguuuacuaguuggu

SEQ ID NO: 717 - RNA, 20 nt, Artificial Sequence
  Synthetic construct: hsa-miR-3115
caacuaguaaacccauauuu

SEQ ID NO: 718 - RNA, 22 nt, Artificial Sequence
  Synthetic construct: hsa-miR-3116
ugccuggaacauaguagggacu

SEQ ID NO: 719 - RNA, 22 nt, Artificial Sequence
  Synthetic construct: hsa-miR-3116
ucccuacuauguuccaggcauu

SEQ ID NO: 720 - RNA, 21 nt, Artificial Sequence
  Synthetic construct: hsa-miR-3117
auaggacucauauagugccag

SEQ ID NO: 721 - RNA, 20 nt, Artificial Sequence
  Synthetic construct: hsa-miR-3117
agacacuauacgagucauau

SEQ ID NO: 722 - RNA, 23 nt, Artificial Sequence
  Synthetic construct: hsa-miR-3118
ugugacugcauuaugaaaauucu

SEQ ID NO: 723 - RNA, 23 nt, Artificial Sequence
  Synthetic construct: hsa-miR-3118
aauuuucauaaugcagucacauu

SEQ ID NO: 724 - RNA, 20 nt, Artificial Sequence
  Synthetic construct: hsa-miR-3119
uggcuuuuaacuuugauggc

SEQ ID NO: 725 - RNA, 20 nt, Artificial Sequence
  Synthetic construct: hsa-miR-3119
caucaaaguuaaaagccauu

SEQ ID NO: 726 - RNA, 21 nt, Artificial Sequence
  Synthetic construct: hsa-miR-3120
ccugucugugccugcuguaca

SEQ ID NO: 727 - RNA, 21 nt, Artificial Sequence
  Synthetic construct: hsa-miR-3120
cacagcaaguguagacaggca

SEQ ID NO: 728 - RNA, 22 nt, Artificial Sequence
  Synthetic construct: hsa-miR-3121
uccuuugccuauucuauuuaag

SEQ ID NO: 729 - RNA, 22 nt, Artificial Sequence
  Synthetic construct: hsa-miR-3121
uaaauagaguaggcaaaggaca

SEQ ID NO: 730 - RNA, 22 nt, Artificial Sequence
  Synthetic construct: hsa-miR-3122
guugggacaagaggacggucuu

SEQ ID NO: 731 - RNA, 22 nt, Artificial Sequence
  Synthetic construct: hsa-miR-3122
gaccguccucuugucccaacuu

SEQ ID NO: 732 - RNA, 17 nt, Artificial Sequence
  Synthetic construct: hsa-miR-3123
cagagaauuguuuaauc

SEQ ID NO: 733 - RNA, 17 nt, Artificial Sequence
  Synthetic construct: hsa-miR-3123
uuaaacaauucucuguu

SEQ ID NO: 734 - RNA, 21 nt, Artificial Sequence
  Synthetic construct: hsa-miR-3124
uucgcgggcgaaggcaaaguc

SEQ ID NO: 735 - RNA, 22 nt, Artificial Sequence
  Synthetic construct: hsa-miR-3124
acuuuccucacucccgugaagu

SEQ ID NO: 736 - RNA, 20 nt, Artificial Sequence
  Synthetic construct: hsa-miR-3125
uagaggaagcuguggagaga

SEQ ID NO: 737 - RNA, 20 nt, Artificial Sequence
  Synthetic construct: hsa-miR-3125
ucuccacagcuuccucuauu

SEQ ID NO: 738 - RNA, 22 nt, Artificial Sequence
  Synthetic construct: hsa-miR-3126
caucuggcauccgucacacaga

SEQ ID NO: 739 - RNA, 22 nt, Artificial Sequence
  Synthetic construct: hsa-miR-3126
ugagggacagaugccagaagca

SEQ ID NO: 740 - RNA, 22 nt, Artificial Sequence
  Synthetic construct: hsa-miR-3127
uccccuucugcaggccugcugg

SEQ ID NO: 741 - RNA, 23 nt, Artificial Sequence
  Synthetic construct: hsa-miR-3127
aucagggcuuguggaaugggaag

SEQ ID NO: 742 - RNA, 23 nt, Artificial Sequence
  Synthetic construct: hsa-miR-3128
ucuggcaaguaaaaaacucucau

SEQ ID NO: 743 - RNA, 23 nt, Artificial Sequence
  Synthetic construct: hsa-miR-3128
gagaguuuuuuacuugccagauu

SEQ ID NO: 744 - RNA, 22 nt, Artificial Sequence
  Synthetic construct: hsa-miR-3129
gcaguaguguagagauugguuu

SEQ ID NO: 745 - RNA, 22 nt, Artificial Sequence
  Synthetic construct: hsa-miR-3129
aaacuaaucucuacacugcugc

SEQ ID NO: 746 - RNA, 21 nt, Artificial Sequence
  Synthetic construct: hsa-miR-3130
gcugcaccggagacuggguaa

SEQ ID NO: 747 - RNA, 21 nt, Artificial Sequence
  Synthetic construct: hsa-miR-3130
uacccagucuccggugcagcc

SEQ ID NO: 748 - RNA, 23 nt, Artificial Sequence
  Synthetic construct: hsa-miR-3131
ucgaggacugguggaagggccuu

SEQ ID NO: 749 - RNA, 23 nt, Artificial Sequence
  Synthetic construct: hsa-miR-3131
ggcccuuccaccaguccucgauu

SEQ ID NO: 750 - RNA, 24 nt, Artificial Sequence
  Synthetic construct: hsa-miR-3132
uggguagagaaggagcucagagga

SEQ ID NO: 751 - RNA, 24 nt, Artificial Sequence
  Synthetic construct: hsa-miR-3132
cucugagcuccuucucuacccauu

SEQ ID NO: 752 - RNA, 22 nt, Artificial Sequence
  Synthetic construct: hsa-miR-3133
uaaagaacucuuaaaacccaau

SEQ ID NO: 753 - RNA, 22 nt, Artificial Sequence
  Synthetic construct: hsa-miR-3133
uggguuuuaagaguucuuuauu

SEQ ID NO: 754 - RNA, 23 nt, Artificial Sequence
  Synthetic construct: hsa-miR-3134
ugauggauaaaagacuacauauu

SEQ ID NO: 755 - RNA, 23 nt, Artificial Sequence
  Synthetic construct: hsa-miR-3134
uauguagucuuuuauccaucauu

SEQ ID NO: 756 - RNA, 22 nt, Artificial Sequence
  Synthetic construct: hsa-miR-3135a
ugccuaggcugagacugcagug

SEQ ID NO: 757 - RNA, 22 nt, Artificial Sequence
  Synthetic construct: hsa-miR-3135a
cugcagucucagccuaggcauu

SEQ ID NO: 758 - RNA, 22 nt, Artificial Sequence
  Synthetic construct: hsa-miR-3135b
ggcuggagcgagugcaguggug

SEQ ID NO: 759 - RNA, 22 nt, Artificial Sequence
  Synthetic construct: hsa-miR-3135b
ccacugcacucgcuccagccuu

SEQ ID NO: 760 - RNA, 23 nt, Artificial Sequence
  Synthetic construct: hsa-miR-3136
cugacugaauagguagggucauu

SEQ ID NO: 761 - RNA, 22 nt, Artificial Sequence
  Synthetic construct: hsa-miR-3136
uggcccaaccuauucaguuagu

SEQ ID NO: 762 - RNA, 24 nt, Artificial Sequence
  Synthetic construct: hsa-miR-3137
ucuguagccugggagcaauggggu

SEQ ID NO: 763 - RNA, 24 nt, Artificial Sequence
  Synthetic construct: hsa-miR-3137
cccauugcucccaggcuacagauu

SEQ ID NO: 764 - RNA, 24 nt, Artificial Sequence
  Synthetic construct: hsa-miR-3138
uguggacagugagguagagggagu

SEQ ID NO: 765 - RNA, 24 nt, Artificial Sequence
  Synthetic construct: hsa-miR-3138
ucccucuaccucacuguccacauu

SEQ ID NO: 766 - RNA, 23 nt, Artificial Sequence
  Synthetic construct: hsa-miR-3139
uaggagcucaacagaugccuguu

SEQ ID NO: 767 - RNA, 23 nt, Artificial Sequence
  Synthetic construct: hsa-miR-3139
caggcaucuguugagcuccuauu

SEQ ID NO: 768 - RNA, 21 nt, Artificial Sequence
  Synthetic construct: hsa-miR-3140
accugaauuaccaaaagcuuu

SEQ ID NO: 769 - RNA, 22 nt, Artificial Sequence
  Synthetic construct: hsa-miR-3140
agcuuuugggaauucagguagu

SEQ ID NO: 770 - RNA, 19 nt, Artificial Sequence
  Synthetic construct: hsa-miR-3141
gagggcggguggaggagga

SEQ ID NO: 771 - RNA, 19 nt, Artificial Sequence
  Synthetic construct: hsa-miR-3141
cuccuccacccgcccucuu

SEQ ID NO: 772 - RNA, 22 nt, Artificial Sequence
  Synthetic construct: hsa-miR-3142
aaggccuuucugaaccuucaga

SEQ ID NO: 773 - RNA, 22 nt, Artificial Sequence
  Synthetic construct: hsa-miR-3142
ugaagguucagaaaggccuuuu

SEQ ID NO: 774 - RNA, 25 nt, Artificial Sequence
  Synthetic construct: hsa-miR-3143
auaacauuguaaagcgcuucuuucg

SEQ ID NO: 775 - RNA, 25 nt, Artificial Sequence
  Synthetic construct: hsa-miR-3143
aaagaagcgcuuuacaauguuauuu

SEQ ID NO: 776 - RNA, 22 nt, Artificial Sequence
  Synthetic construct: hsa-miR-3144
auauaccuguucggucucuuua

SEQ ID NO: 777 - RNA, 22 nt, Artificial Sequence
  Synthetic construct: hsa-miR-3144
aggggaccaaagagauauauag

SEQ ID NO: 778 - RNA, 24 nt, Artificial Sequence
  Synthetic construct: hsa-miR-3145
agauauuuugaguguuuggaauug

SEQ ID NO: 779 - RNA, 22 nt, Artificial Sequence
  Synthetic construct: hsa-miR-3145
aacuccaaacacucaaaacuca

SEQ ID NO: 780 - RNA, 22 nt, Artificial Sequence
  Synthetic construct: hsa-miR-3146
caugcuaggauagaaagaaugg

SEQ ID NO: 781 - RNA, 22 nt, Artificial Sequence
  Synthetic construct: hsa-miR-3146
auucuuucuauccuagcauguu

SEQ ID NO: 782 - RNA, 24 nt, Artificial Sequence
  Synthetic construct: hsa-miR-3147
gguugggcagugaggaggguguga

SEQ ID NO: 783 - RNA, 24 nt, Artificial Sequence
  Synthetic construct: hsa-miR-3147
acacccuccucacugcccaaccuu

SEQ ID NO: 784 - RNA, 22 nt, Artificial Sequence
  Synthetic construct: hsa-miR-3148
uggaaaaaacuggugugugcuu

SEQ ID NO: 785 - RNA, 22 nt, Artificial Sequence
  Synthetic construct: hsa-miR-3148
gcacacaccaguuuuuuccauu

SEQ ID NO: 786 - RNA, 23 nt, Artificial Sequence
  Synthetic construct: hsa-miR-3149
uuuguauggauauguguguguau

SEQ ID NO: 787 - RNA, 23 nt, Artificial Sequence
  Synthetic construct: hsa-miR-3149
acacacacauauccauacaaauu

SEQ ID NO: 788 - RNA, 22 nt, Artificial Sequence
  Synthetic construct: hsa-miR-3150a
caaccucgacgaucuccucagc

SEQ ID NO: 789 - RNA, 22 nt, Artificial Sequence
  Synthetic construct: hsa-miR-3150a
cuggggagauccucgagguugg

SEQ ID NO: 790 - RNA, 22 nt, Artificial Sequence
  Synthetic construct: hsa-miR-3150b
caaccucgaggaucuccccagc

SEQ ID NO: 791 - RNA, 21 nt, Artificial Sequence
  Synthetic construct: hsa-miR-3150b
ugaggagaucgucgagguugg

SEQ ID NO: 792 - RNA, 21 nt, Artificial Sequence
  Synthetic construct: hsa-miR-3151
gguggggcaaugggaucaggu

SEQ ID NO: 793 - RNA, 20 nt, Artificial Sequence
  Synthetic construct: hsa-miR-3151
ccugaucccacagcccaccu

SEQ ID NO: 794 - RNA, 22 nt, Artificial Sequence
  Synthetic construct: hsa-miR-3152
auugccucuguucuaacacaag

SEQ ID NO: 795 - RNA, 22 nt, Artificial Sequence
  Synthetic construct: hsa-miR-3152
uguguuagaauaggggcaauaa

SEQ ID NO: 796 - RNA, 23 nt, Artificial Sequence
  Synthetic construct: hsa-miR-3153
ggggaaagcgaguagggacauuu

SEQ ID NO: 797 - RNA, 23 nt, Artificial Sequence
  Synthetic construct: hsa-miR-3153
augucccuacucgcuuuccccuu

SEQ ID NO: 798 - RNA, 22 nt, Artificial Sequence
  Synthetic construct: hsa-miR-3154
cagaaggggaguugggagcaga

SEQ ID NO: 799 - RNA, 22 nt, Artificial Sequence
  Synthetic construct: hsa-miR-3154
ugcucccaacuccccuucuguu

SEQ ID NO: 800 - RNA, 21 nt, Artificial Sequence
  Synthetic construct: hsa-miR-3155a
ccaggcucugcagugggaacu

SEQ ID NO: 801 - RNA, 21 nt, Artificial Sequence
  Synthetic construct: hsa-miR-3155a
uucccacugcagagccugguu

SEQ ID NO: 802 - RNA, 18 nt, Artificial Sequence
  Synthetic construct: hsa-miR-3155b
ccaggcucugcaguggga

SEQ ID NO: 803 - RNA, 18 nt, Artificial Sequence
  Synthetic construct: hsa-miR-3155b
ccacugcagagccugguu

SEQ ID NO: 804 - RNA, 21 nt, Artificial Sequence
  Synthetic construct: hsa-miR-3156
cucccacuuccagaucuuucu

SEQ ID NO: 805 - RNA, 22 nt, Artificial Sequence
  Synthetic construct: hsa-miR-3156
aaagaucuggaagugggagaca

SEQ ID NO: 806 - RNA, 22 nt, Artificial Sequence
  Synthetic construct: hsa-miR-3157
cugcccuagucuagcugaagcu

SEQ ID NO: 807 - RNA, 22 nt, Artificial Sequence
  Synthetic construct: hsa-miR-3157
uucagccaggcuagugcagucu

SEQ ID NO: 808 - RNA, 22 nt, Artificial Sequence
  Synthetic construct: hsa-miR-3158
aagggcuuccucucugcaggac

SEQ ID NO: 809 - RNA, 21 nt, Artificial Sequence
  Synthetic construct: hsa-miR-3158
ccugcagagaggaagcccuuc

SEQ ID NO: 810 - RNA, 22 nt, Artificial Sequence
  Synthetic construct: hsa-miR-3159
uaggauuacaagugucggccac

SEQ ID NO: 811 - RNA, 22 nt, Artificial Sequence
  Synthetic construct: hsa-miR-3159
ggccgacacuuguaauccuauu

SEQ ID NO: 812 - RNA, 22 nt, Artificial Sequence
  Synthetic construct: hsa-miR-3160
agagcugagacuagaaagccca

SEQ ID NO: 813 - RNA, 22 nt, Artificial Sequence
  Synthetic construct: hsa-miR-3160
ggcuuucuagucucagcucucc

SEQ ID NO: 814 - RNA, 23 nt, Artificial Sequence
  Synthetic construct: hsa-miR-3161
cugauaagaacagaggcccagau

SEQ ID NO: 815 - RNA, 23 nt, Artificial Sequence
  Synthetic construct: hsa-miR-3161
cugggccucuguucuuaucaguu

SEQ ID NO: 816 - RNA, 23 nt, Artificial Sequence
  Synthetic construct: hsa-miR-3162
uuagggaguagaaggguggggag

SEQ ID NO: 817 - RNA, 21 nt, Artificial Sequence
  Synthetic construct: hsa-miR-3162
ucccuaccccuccacucccca

SEQ ID NO: 818 - RNA, 22 nt, Artificial Sequence
  Synthetic construct: hsa-miR-3163
uauaaaaugagggcaguaagac

SEQ ID NO: 819 - RNA, 22 nt, Artificial Sequence
  Synthetic construct: hsa-miR-3163
cuuacugcccucauuuuauauu

SEQ ID NO: 820 - RNA, 22 nt, Artificial Sequence
  Synthetic construct: hsa-miR-3164
ugugacuuuaagggaaauggcg

SEQ ID NO: 821 - RNA, 22 nt, Artificial Sequence
  Synthetic construct: hsa-miR-3164
ccauuucccuuaaagucacauu

SEQ ID NO: 822 - RNA, 22 nt, Artificial Sequence
  Synthetic construct: hsa-miR-3165
agguggaugcaaugugaccuca

SEQ ID NO: 823 - RNA, 22 nt, Artificial Sequence
  Synthetic construct: hsa-miR-3165
aggucacauugcauccaccuuu

SEQ ID NO: 824 - RNA, 23 nt, Artificial Sequence
  Synthetic construct: hsa-miR-3166
cgcagacaaugccuacuggccua

SEQ ID NO: 825 - RNA, 23 nt, Artificial Sequence
  Synthetic construct: hsa-miR-3166
ggccaguaggcauugucugcguu

SEQ ID NO: 826 - RNA, 22 nt, Artificial Sequence
  Synthetic construct: hsa-miR-3167
aggauuucagaaauacuggugu

SEQ ID NO: 827 - RNA, 22 nt, Artificial Sequence
  Synthetic construct: hsa-miR-3167
accaguauuucugaaauccuuu

SEQ ID NO: 828 - RNA, 17 nt, Artificial Sequence
  Synthetic construct: hsa-miR-3168
gaguucuacagucagac

SEQ ID NO: 829 - RNA, 17 nt, Artificial Sequence
  Synthetic construct: hsa-miR-3168
cugacuguagaacucuu

SEQ ID NO: 830 - RNA, 22 nt, Artificial Sequence
  Synthetic construct: hsa-miR-3169
uaggacugugcuuggcacauag

SEQ ID NO: 831 - RNA, 22 nt, Artificial Sequence
  Synthetic construct: hsa-miR-3169
augugccaagcacaguccuauu

SEQ ID NO: 832 - RNA, 22 nt, Artificial Sequence
  Synthetic construct: hsa-miR-3170
cugggguucugagacagacagu

SEQ ID NO: 833 - RNA, 22 nt, Artificial Sequence
  Synthetic construct: hsa-miR-3170
ugucugucucagaaccccaguu

SEQ ID NO: 834 - RNA, 24 nt, Artificial Sequence
  Synthetic construct: hsa-miR-3171
agauguauggaaucuguauauauc

SEQ ID NO: 835 - RNA, 24 nt, Artificial Sequence
  Synthetic construct: hsa-miR-3171
uauauacagauuccauacaucuuu

SEQ ID NO: 836 - RNA, 22 nt, Artificial Sequence
  Synthetic construct: hsa-miR-3173
aaaggaggaaauaggcaggcca

SEQ ID NO: 837 - RNA, 22 nt, Artificial Sequence
  Synthetic construct: hsa-miR-3173
ugcccugccuguuuucuccuuu

SEQ ID NO: 838 - RNA, 23 nt, Artificial Sequence
  Synthetic construct: hsa-miR-3174
uagugaguuagagaugcagagcc

SEQ ID NO: 839 - RNA, 23 nt, Artificial Sequence
  Synthetic construct: hsa-miR-3174
cucugcaucucuaacucacuauu

SEQ ID NO: 840 - RNA, 22 nt, Artificial Sequence
  Synthetic construct: hsa-miR-3175
cggggagagaacgcagugacgu

SEQ ID NO: 841 - RNA, 22 nt, Artificial Sequence
  Synthetic construct: hsa-miR-3175
gucacugcguucucuccccguu

SEQ ID NO: 842 - RNA, 19 nt, Artificial Sequence
  Synthetic construct: hsa-miR-3176
acuggccugggacuaccgg

SEQ ID NO: 843 - RNA, 19 nt, Artificial Sequence
  Synthetic construct: hsa-miR-3176
gguagucccaggccaguuu

SEQ ID NO: 844 - RNA, 23 nt, Artificial Sequence
  Synthetic construct: hsa-miR-3177
uguguacacacgugccaggcgcu

SEQ ID NO: 845 - RNA, 21 nt, Artificial Sequence
  Synthetic construct: hsa-miR-3177
ugcacggcacuggggacacgu

SEQ ID NO: 846 - RNA, 17 nt, Artificial Sequence
  Synthetic construct: hsa-miR-3178
ggggcgcggccggaucg

SEQ ID NO: 847 - RNA, 17 nt, Artificial Sequence
  Synthetic construct: hsa-miR-3178
auccggccgcgccccuu

SEQ ID NO: 848 - RNA, 22 nt, Artificial Sequence
  Synthetic construct: hsa-miR-3179
agaaggggugaaauuuaaacgu

SEQ ID NO: 849 - RNA, 22 nt, Artificial Sequence
  Synthetic construct: hsa-miR-3179
guuuaaauuucaccccuucuuu

SEQ ID NO: 850 - RNA, 25 nt, Artificial Sequence
  Synthetic construct: hsa-miR-3180
cuuccagacgcuccgccccacgucg

SEQ ID NO: 851 - RNA, 22 nt, Artificial Sequence
  Synthetic construct: hsa-miR-3180
uggggcggagcuuccggaggcc

SEQ ID NO: 852 - RNA, 19 nt, Artificial Sequence
  Synthetic construct: hsa-miR-3181
aucgggcccucggcgccgg

SEQ ID NO: 853 - RNA, 19 nt, Artificial Sequence
  Synthetic construct: hsa-miR-3181
ggcgccgagggcccgauuu

SEQ ID NO: 854 - RNA, 17 nt, Artificial Sequence
  Synthetic construct: hsa-miR-3182
gcuucuguaguguaguc

SEQ ID NO: 855 - RNA, 17 nt, Artificial Sequence
  Synthetic construct: hsa-miR-3182
cuacacuacagaagcuu

SEQ ID NO: 856 - RNA, 22 nt, Artificial Sequence
  Synthetic construct: hsa-miR-3183
gccucucucggagucgcucgga

SEQ ID NO: 857 - RNA, 22 nt, Artificial Sequence
  Synthetic construct: hsa-miR-3183
cgagcgacuccgagagaggcuu

SEQ ID NO: 858 - RNA, 23 nt, Artificial Sequence
  Synthetic construct: hsa-miR-3184
aaagucucgcucucugccccuca

SEQ ID NO: 859 - RNA, 24 nt, Artificial Sequence
  Synthetic construct: hsa-miR-3184
ugaggggccucagaccgagcuuuu

SEQ ID NO: 860 - RNA, 23 nt, Artificial Sequence
  Synthetic construct: hsa-miR-3185
agaagaaggcggucggucugcgg

SEQ ID NO: 861 - RNA, 23 nt, Artificial Sequence
  Synthetic construct: hsa-miR-3185
gcagaccgaccgccuucuucuuu

SEQ ID NO: 862 - RNA, 22 nt, Artificial Sequence
  Synthetic construct: hsa-miR-3186
caggcgucugucuacguggcuu

SEQ ID NO: 863 - RNA, 21 nt, Artificial Sequence
  Synthetic construct: hsa-miR-3186
ucacgcggagagauggcuuug

SEQ ID NO: 864 - RNA, 20 nt, Artificial Sequence
  Synthetic construct: hsa-miR-3187
uuggccauggggcugcgcgg

SEQ ID NO: 865 - RNA, 23 nt, Artificial Sequence
  Synthetic construct: hsa-miR-3187
ccugggcagcguguggcugaagg

SEQ ID NO: 866 - RNA, 23 nt, Artificial Sequence
  Synthetic construct: hsa-miR-3188
agaggcuuugugcggauacgggg

SEQ ID NO: 867 - RNA, 23 nt, Artificial Sequence
  Synthetic construct: hsa-miR-3188
ccguauccgcacaaagccucuuu

SEQ ID NO: 868 - RNA, 21 nt, Artificial Sequence
  Synthetic construct: hsa-miR-3189
cccuugggucugaugggguag

SEQ ID NO: 869 - RNA, 25 nt, Artificial Sequence
  Synthetic construct: hsa-miR-3189
ugccccaucugugcccuggguagga

SEQ ID NO: 870 - RNA, 23 nt, Artificial Sequence
  Synthetic construct: hsa-miR-3190
uguggaagguagacggccagaga

SEQ ID NO: 871 - RNA, 20 nt, Artificial Sequence
  Synthetic construct: hsa-miR-3190
ucuggccagcuacgucccca

SEQ ID NO: 872 - RNA, 22 nt, Artificial Sequence
  Synthetic construct: hsa-miR-3191
cucucuggccgucuaccuucca

SEQ ID NO: 873 - RNA, 23 nt, Artificial Sequence
  Synthetic construct: hsa-miR-3191
uggggacguagcuggccagacag

SEQ ID NO: 874 - RNA, 23 nt, Artificial Sequence
  Synthetic construct: hsa-miR-3192
ucugggagguuguagcaguggaa

SEQ ID NO: 875 - RNA, 21 nt, Artificial Sequence
  Synthetic construct: hsa-miR-3192
cucugaucgcccucucagcuc

SEQ ID NO: 876 - RNA, 22 nt, Artificial Sequence
  Synthetic construct: hsa-miR-3193
uccugcguaggaucugaggagu

SEQ ID NO: 877 - RNA, 22 nt, Artificial Sequence
  Synthetic construct: hsa-miR-3193
uccucagauccuacgcaggauu

SEQ ID NO: 878 - RNA, 22 nt, Artificial Sequence
  Synthetic construct: hsa-miR-3194
agcucugcugcucacuggcagu

SEQ ID NO: 879 - RNA, 21 nt, Artificial Sequence
  Synthetic construct: hsa-miR-3194
ggccagccaccaggagggcug

SEQ ID NO: 880 - RNA, 17 nt, Artificial Sequence
  Synthetic construct: hsa-miR-3195
cgcgccgggcccggguu

SEQ ID NO: 881 - RNA, 17 nt, Artificial Sequence
  Synthetic construct: hsa-miR-3195
cccgggcccggcgcguu

SEQ ID NO: 882 - RNA, 18 nt, Artificial Sequence
  Synthetic construct: hsa-miR-3196
cggggcggcaggggccuc

SEQ ID NO: 883 - RNA, 18 nt, Artificial Sequence
  Synthetic construct: hsa-miR-3196
ggccccugccgccccguu

SEQ ID NO: 884 - RNA, 23 nt, Artificial Sequence
  Synthetic construct: hsa-miR-3197
ggaggcgcaggcucggaaaggcg

SEQ ID NO: 885 - RNA, 23 nt, Artificial Sequence
  Synthetic construct: hsa-miR-3197
ccuuuccgagccugcgccuccuu

SEQ ID NO: 886 - RNA, 22 nt, Artificial Sequence
  Synthetic construct: hsa-miR-3198
guggaguccuggggaauggaga

SEQ ID NO: 887 - RNA, 22 nt, Artificial Sequence
  Synthetic construct: hsa-miR-3198
uccauuccccaggacuccacuu

SEQ ID NO: 888 - RNA, 23 nt, Artificial Sequence
  Synthetic construct: hsa-miR-3199
agggacugccuuaggagaaaguu

SEQ ID NO: 889 - RNA, 23 nt, Artificial Sequence
  Synthetic construct: hsa-miR-3199
cuuucuccuaaggcagucccuuu

SEQ ID NO: 890 - RNA, 22 nt, Artificial Sequence
  Synthetic construct: hsa-miR-32
caauuuagugugugugauauuu

SEQ ID NO: 891 - RNA, 22 nt, Artificial Sequence
  Synthetic construct: hsa-miR-32
uauugcacauuacuaaguugca

SEQ ID NO: 892 - RNA, 22 nt, Artificial Sequence
  Synthetic construct: hsa-miR-3200
caccuugcgcuacucaggucug

SEQ ID NO: 893 - RNA, 22 nt, Artificial Sequence
  Synthetic construct: hsa-miR-3200
aaucugagaaggcgcacaaggu

SEQ ID NO: 894 - RNA, 17 nt, Artificial Sequence
  Synthetic construct: hsa-miR-3201
gggauaugaagaaaaau

SEQ ID NO: 895 - RNA, 17 nt, Artificial Sequence
  Synthetic construct: hsa-miR-3201
uuuucuucauaucccuu

SEQ ID NO: 896 - RNA, 22 nt, Artificial Sequence
  Synthetic construct: hsa-miR-3202
uggaagggagaagagcuuuaau

SEQ ID NO: 897 - RNA, 22 nt, Artificial Sequence
  Synthetic construct: hsa-miR-3202
uaaagcucuucucccuuccauu

SEQ ID NO: 898 - RNA, 22 nt, Artificial Sequence
  Synthetic construct: hsa-miR-320a
aaaagcuggguugagagggcga

SEQ ID NO: 899 - RNA, 22 nt, Artificial Sequence
  Synthetic construct: hsa-miR-320a
gcccucucaacccagcuuuuuu

SEQ ID NO: 900 - RNA, 22 nt, Artificial Sequence
  Synthetic construct: hsa-miR-320b
aaaagcuggguugagagggcaa

SEQ ID NO: 901 - RNA, 22 nt, Artificial Sequence
  Synthetic construct: hsa-miR-320b
gcccucucaacccagcuuuuuu

SEQ ID NO: 902 - RNA, 20 nt, Artificial Sequence
  Synthetic construct: hsa-miR-320c
aaaagcuggguugagagggu

SEQ ID NO: 903 - RNA, 20 nt, Artificial Sequence
  Synthetic construct: hsa-miR-320c
ccucucaacccagcuuuuuu

SEQ ID NO: 904 - RNA, 19 nt, Artificial Sequence
  Synthetic construct: hsa-miR-320d
aaaagcuggguugagagga

SEQ ID NO: 905 - RNA, 19 nt, Artificial Sequence
  Synthetic construct: hsa-miR-320d
cucucaacccagcuuuuuu

SEQ ID NO: 906 - RNA, 18 nt, Artificial Sequence
  Synthetic construct: hsa-miR-320e
aaagcuggguugagaagg

SEQ ID NO: 907 - RNA, 18 nt, Artificial Sequence
  Synthetic construct: hsa-miR-320e
uucucaacccagcuuuuu

SEQ ID NO: 908 - RNA, 22 nt, Artificial Sequence
  Synthetic construct: hsa-miR-323a
aggugguccguggcgcguucgc

SEQ ID NO: 909 - RNA, 21 nt, Artificial Sequence
  Synthetic construct: hsa-miR-323a
cacauuacacggucgaccucu

SEQ ID NO: 910 - RNA, 23 nt, Artificial Sequence
  Synthetic construct: hsa-miR-323b
agguuguccguggugaguucgca

SEQ ID NO: 911 - RNA, 22 nt, Artificial Sequence
  Synthetic construct: hsa-miR-323b
cccaauacacggucgaccucuu

SEQ ID NO: 912 - RNA, 23 nt, Artificial Sequence
  Synthetic construct: hsa-miR-324
cgcauccccuagggcauuggugu

SEQ ID NO: 913 - RNA, 20 nt, Artificial Sequence
  Synthetic construct: hsa-miR-324
acugccccaggugcugcugg

SEQ ID NO: 914 - RNA, 23 nt, Artificial Sequence
  Synthetic construct: hsa-miR-325
ccuaguagguguccaguaagugu

SEQ ID NO: 915 - RNA, 23 nt, Artificial Sequence
  Synthetic construct: hsa-miR-325
acuuacuggacaccuacuagguu

SEQ ID NO: 916 - RNA, 20 nt, Artificial Sequence
  Synthetic construct: hsa-miR-326
ccucugggcccuuccuccag

SEQ ID NO: 917 - RNA, 20 nt, Artificial Sequence
  Synthetic construct: hsa-miR-326
ggaggaagggcccagagguu

SEQ ID NO: 918 - RNA, 22 nt, Artificial Sequence
  Synthetic construct: hsa-miR-328
cuggcccucucugcccuuccgu

SEQ ID NO: 919 - RNA, 23 nt, Artificial Sequence
  Synthetic construct: hsa-miR-328
gggggggcaggaggggcucaggg

SEQ ID NO: 920 - RNA, 22 nt, Artificial Sequence
  Synthetic construct: hsa-miR-329
aacacaccugguuaaccucuuu

SEQ ID NO: 921 - RNA, 23 nt, Artificial Sequence
  Synthetic construct: hsa-miR-329
gagguuuucuggguuucuguuuc

SEQ ID NO: 922 - RNA, 23 nt, Artificial Sequence
  Synthetic construct: hsa-miR-330
gcaaagcacacggccugcagaga

SEQ ID NO: 923 - RNA, 22 nt, Artificial Sequence
  Synthetic construct: hsa-miR-330
ucucugggccugugucuuaggc

SEQ ID NO: 924 - RNA, 22 nt, Artificial Sequence
  Synthetic construct: hsa-miR-331
cuagguauggucccagggaucc

SEQ ID NO: 925 - RNA, 21 nt, Artificial Sequence
  Synthetic construct: hsa-miR-331
gccccugggccuauccuagaa

SEQ ID NO: 926 - RNA, 23 nt, Artificial Sequence
  Synthetic construct: hsa-miR-335
ucaagagcaauaacgaaaaaugu

SEQ ID NO: 927 - RNA, 22 nt, Artificial Sequence
  Synthetic construct: hsa-miR-335
uuuuucauuauugcuccugacc

SEQ ID NO: 928 - RNA, 21 nt, Artificial Sequence
  Synthetic construct: hsa-miR-337
gaacggcuucauacaggaguu

SEQ ID NO: 929 - RNA, 22 nt, Artificial Sequence
  Synthetic construct: hsa-miR-337
cuccuauaugaugccuuucuuc

SEQ ID NO: 930 - RNA, 22 nt, Artificial Sequence
  Synthetic construct: hsa-miR-338
uccagcaucagugauuuuguug

SEQ ID NO: 931 - RNA, 22 nt, Artificial Sequence
  Synthetic construct: hsa-miR-338
aacaauauccuggugcugagug

SEQ ID NO: 932 - RNA, 23 nt, Artificial Sequence
  Synthetic construct: hsa-miR-339
ugagcgccucgacgacagagccg

SEQ ID NO: 933 - RNA, 23 nt, Artificial Sequence
  Synthetic construct: hsa-miR-339
ucccuguccuccaggagcucacg

SEQ ID NO: 934 - RNA, 21 nt, Artificial Sequence
  Synthetic construct: hsa-miR-33a
gugcauuguaguugcauugca

SEQ ID NO: 935 - RNA, 22 nt, Artificial Sequence
  Synthetic construct: hsa-miR-33a
caauguuuccacagugcaucac

SEQ ID NO: 936 - RNA, 20 nt, Artificial Sequence
  Synthetic construct: hsa-miR-33b
gugcauugcuguugcauugc

SEQ ID NO: 937 - RNA, 22 nt, Artificial Sequence
  Synthetic construct: hsa-miR-33b
cagugccucggcagugcagccc

SEQ ID NO: 938 - RNA, 22 nt, Artificial Sequence
  Synthetic construct: hsa-miR-340
uccgucucaguuacuuuauagc

SEQ ID NO: 939 - RNA, 22 nt, Artificial Sequence
  Synthetic construct: hsa-miR-340
uuauaaagcaaugagacugauu

SEQ ID NO: 940 - RNA, 23 nt, Artificial Sequence
  Synthetic construct: hsa-miR-342
ucucacacagaaaucgcacccgu

SEQ ID NO: 941 - RNA, 21 nt, Artificial Sequence
  Synthetic construct: hsa-miR-342
aggggugcuaucugugauuga

SEQ ID NO: 942 - RNA, 22 nt, Artificial Sequence
  Synthetic construct: hsa-miR-345
gcccugaacgaggggucuggag

SEQ ID NO: 943 - RNA, 22 nt, Artificial Sequence
  Synthetic construct: hsa-miR-345
gcugacuccuaguccagggcuc

SEQ ID NO: 944 - RNA, 23 nt, Artificial Sequence
  Synthetic construct: hsa-miR-346
ugucugcccgcaugccugccucu

SEQ ID NO: 945 - RNA, 23 nt, Artificial Sequence
  Synthetic construct: hsa-miR-346
aggcaggcaugcgggcagacauu

SEQ ID NO: 946 - RNA, 22 nt, Artificial Sequence
  Synthetic construct:
uggcagugucuuagcugguugu

SEQ ID NO: 947 - RNA, 22 nt, Artificial Sequence
  Synthetic construct: hsa-miR-34a
caaucagcaaguauacugcccu

SEQ ID NO: 948 - RNA, 23 nt, Artificial Sequence
  Synthetic construct: hsa-miR-34b
uaggcagugucauuagcugauug

SEQ ID NO: 949 - RNA, 22 nt, Artificial Sequence
  Synthetic construct: hsa-miR-34b
caaucacuaacuccacugccau

SEQ ID NO: 950 - RNA, 22 nt, Artificial Sequence
  Synthetic construct: hsa-miR-34c
aaucacuaaccacacggccagg

SEQ ID NO: 951 - RNA, 23 nt, Artificial Sequence
  Synthetic construct: hsa-miR-34c
aggcaguguaguuagcugauugc

SEQ ID NO: 952 - RNA, 24 nt, Artificial Sequence
  Synthetic construct: hsa-miR-3529
aacaacaaaaucacuagucuucca

SEQ ID NO: 953 - RNA, 22 nt, Artificial Sequence
  Synthetic construct: hsa-miR-3529
agguagacugggauuuguuguu

SEQ ID NO: 954 - RNA, 22 nt, Artificial Sequence
  Synthetic construct: hsa-miR-3591
aaacaccauugucacacuccac

SEQ ID NO: 955 - RNA, 23 nt, Artificial Sequence
  Synthetic construct: hsa-miR-3591
uuuagugugauaauggcguuuga

SEQ ID NO: 956 - RNA, 23 nt, Artificial Sequence
  Synthetic construct: hsa-miR-3605
ccuccguguuaccuguccucuag

SEQ ID NO: 957 - RNA, 23 nt, Artificial Sequence
  Synthetic construct: hsa-miR-3605
ugaggauggauagcaaggaagcc

SEQ ID NO: 958 - RNA, 21 nt, Artificial Sequence
  Synthetic construct: hsa-miR-3606
uuagugaaggcuauuuuaauu

SEQ ID NO: 959 - RNA, 21 nt, Artificial Sequence
  Synthetic construct: hsa-miR-3606
aaaauuucuuucacuacuuag

SEQ ID NO: 960 - RNA, 20 nt, Artificial Sequence
  Synthetic construct: hsa-miR-3607
acuguaaacgcuuucugaug

SEQ ID NO: 961 - RNA, 22 nt, Artificial Sequence
  Synthetic construct: hsa-miR-3607
gcaugugaugaagcaaaucagu

SEQ ID NO: 962 - RNA, 24 nt, Artificial Sequence
  Synthetic construct: hsa-miR-3609
caaagugaugaguaauacuggcug

SEQ ID NO: 963 - RNA, 24 nt, Artificial Sequence
  Synthetic construct: hsa-miR-3609
gccaguauuacucaucacuuuguu

SEQ ID NO: 964 - RNA, 23 nt, Artificial Sequence
  Synthetic construct: hsa-miR-361
ucccccaggugugauucugauuu

SEQ ID NO: 965 - RNA, 22 nt, Artificial Sequence
  Synthetic construct: hsa-miR-361
uuaucagaaucuccagggguac

SEQ ID NO: 966 - RNA, 20 nt, Artificial Sequence
  Synthetic construct: hsa-miR-3610
gaaucggaaaggaggcgccg

SEQ ID NO: 967 - RNA, 20 nt, Artificial Sequence
  Synthetic construct: hsa-miR-3610
gcgccuccuuuccgauucuu

SEQ ID NO: 968 - RNA, 21 nt, Artificial Sequence
  Synthetic construct: hsa-miR-3611
uugugaagaaagaaauucuua

SEQ ID NO: 969 - RNA, 21 nt, Artificial Sequence
  Synthetic construct: hsa-miR-3611
agaauuucuuucuucacaauu

SEQ ID NO: 970 - RNA, 22 nt, Artificial Sequence
  Synthetic construct: hsa-miR-3612
aggaggcaucuugagaaaugga

SEQ ID NO: 971 - RNA, 22 nt, Artificial Sequence
  Synthetic construct: hsa-miR-3612
cauuucucaagaugccuccuuu

SEQ ID NO: 972 - RNA, 22 nt, Artificial Sequence
  Synthetic construct: hsa-miR-3613
uguuguacuuuuuuuuuuguuc

SEQ ID NO: 973 - RNA, 24 nt, Artificial Sequence
  Synthetic construct: hsa-miR-3613
acaaaaaaaaaagcccaacccuuc

SEQ ID NO: 974 - RNA, 23 nt, Artificial Sequence
  Synthetic construct: hsa-miR-3614
ccacuuggaucugaaggcugccc

SEQ ID NO: 975 - RNA, 23 nt, Artificial Sequence
  Synthetic construct: hsa-miR-3614
uagccuucagaucuugguguuuu

SEQ ID NO: 976 - RNA, 21 nt, Artificial Sequence
  Synthetic construct: hsa-miR-3615
ucucucggcuccucgcggcuc

SEQ ID NO: 977 - RNA, 21 nt, Artificial Sequence
  Synthetic construct: hsa-miR-3615
gccgcgaggagccgagagauu

SEQ ID NO: 978 - RNA, 22 nt, Artificial Sequence
  Synthetic construct: hsa-miR-3616
augaagugcacucaugauaugu

SEQ ID NO: 979 - RNA, 23 nt, Artificial Sequence
  Synthetic construct: hsa-miR-3616
cgagggcauuucaugaugcaggc

SEQ ID NO: 980 - RNA, 23 nt, Artificial Sequence
  Synthetic construct: hsa-miR-3617
caucagcacccuauguccuuucu

SEQ ID NO: 981 - RNA, 22 nt, Artificial Sequence
  Synthetic construct: hsa-miR-3617
aaagacauaguugcaagauggg

SEQ ID NO: 982 - RNA, 22 nt, Artificial Sequence
  Synthetic construct: hsa-miR-3618
ugucuacauuaaugaaaagagc

SEQ ID NO: 983 - RNA, 22 nt, Artificial Sequence
  Synthetic construct: hsa-miR-3618
ucuuuucauuaauguagacauu

SEQ ID NO: 984 - RNA, 22 nt, Artificial Sequence
  Synthetic construct: hsa-miR-3619
ucagcaggcaggcuggugcagc

SEQ ID NO: 985 - RNA, 22 nt, Artificial Sequence
  Synthetic construct: hsa-miR-3619
gggaccauccugccugcugugg

SEQ ID NO: 986 - RNA, 22 nt, Artificial Sequence
  Synthetic construct: hsa-miR-362
aacacaccuauucaaggauuca

SEQ ID NO: 987 - RNA, 24 nt, Artificial Sequence
  Synthetic construct: hsa-miR-362
aauccuuggaaccuaggugugagu

SEQ ID NO: 988 - RNA, 22 nt, Artificial Sequence
  Synthetic construct: hsa-miR-3620
ucacccugcaucccgcacccag

SEQ ID NO: 989 - RNA, 22 nt, Artificial Sequence
  Synthetic construct: hsa-miR-3620
gugggcugggcugggcugggcc

SEQ ID NO: 990 - RNA, 20 nt, Artificial Sequence
  Synthetic construct: hsa-miR-3621
cgcgggucggggucugcagg

SEQ ID NO: 991 - RNA, 20 nt, Artificial Sequence
  Synthetic construct: hsa-miR-3621
ugcagaccccgacccgcguu

SEQ ID NO: 992 - RNA, 22 nt, Artificial Sequence
  Synthetic construct: hsa-miR-3622a
ucaccugaccucccaugccugu

SEQ ID NO: 993 - RNA, 22 nt, Artificial Sequence
  Synthetic construct: hsa-miR-3622a
caggcacgggagcucaggugag

SEQ ID NO: 994 - RNA, 21 nt, Artificial Sequence
  Synthetic construct: hsa-miR-3622b
ucaccugagcucccgugccug

SEQ ID NO: 995 - RNA, 20 nt, Artificial Sequence
  Synthetic construct: hsa-miR-3622b
aggcaugggaggucagguga

SEQ ID NO: 996 - RNA, 22 nt, Artificial Sequence
  Synthetic construct: hsa-miR-363
aauugcacgguauccaucugua

SEQ ID NO: 997 - RNA, 22 nt, Artificial Sequence
  Synthetic construct: hsa-miR-363
cggguggaucacgaugcaauuu

SEQ ID NO: 998 - RNA, 22 nt, Artificial Sequence
  Synthetic construct: hsa-miR-3646
aaaaugaaaugagcccagccca

SEQ ID NO: 999 - RNA, 22 nt, Artificial Sequence
  Synthetic construct: hsa-miR-3646
ggcugggcucauuucauuuuuu

SEQ ID NO: 1000 - RNA, 21 nt, Artificial Sequence
  Synthetic construct: hsa-miR-3648
agccgcggggaucgccgaggg

SEQ ID NO: 1001 - RNA, 21 nt, Artificial Sequence
  Synthetic construct: hsa-miR-3648
cucggcgauccccgcggcuuu

SEQ ID NO: 1002 - RNA, 19 nt, Artificial Sequence
  Synthetic construct: hsa-miR-3649
agggaccugagugucuaag

SEQ ID NO: 1003 - RNA, 19 nt, Artificial Sequence
  Synthetic construct: hsa-miR-3649
uagacacucaggucccuuu

SEQ ID NO: 1004 - RNA, 19 nt, Artificial Sequence
  Synthetic construct: hsa-miR-3650
aggugugucuguagagucc

SEQ ID NO: 1005 - RNA, 19 nt, Artificial Sequence
  Synthetic construct: hsa-miR-3650
acucuacagacacaccuuu

SEQ ID NO: 1006 - RNA, 24 nt, Artificial Sequence
  Synthetic construct: hsa-miR-3651
cauagcccggucgcugguacauga

SEQ ID NO: 1007 - RNA, 24 nt, Artificial Sequence
  Synthetic construct: hsa-miR-3651
auguaccagcgaccgggcuauguu

SEQ ID NO: 1008 - RNA, 18 nt, Artificial Sequence
  Synthetic construct: hsa-miR-3652
cggcuggaggugugagga

SEQ ID NO: 1009 - RNA, 18 nt, Artificial Sequence
  Synthetic construct: hsa-miR-3652
cucacaccuccagccguu

SEQ ID NO: 1010 - RNA, 20 nt, Artificial Sequence
  Synthetic construct: hsa-miR-3653
ccuccugaugauucuucuuc

SEQ ID NO: 1011 - RNA, 18 nt, Artificial Sequence
  Synthetic construct: hsa-miR-3653
cuaagaaguugacugaag

SEQ ID NO: 1012 - RNA, 19 nt, Artificial Sequence
  Synthetic construct: hsa-miR-3654
gacuggacaagcugaggaa

SEQ ID NO: 1013 - RNA, 19 nt, Artificial Sequence
  Synthetic construct: hsa-miR-3654
ccucagcuuguccagucuu

SEQ ID NO: 1014 - RNA, 21 nt, Artificial Sequence
  Synthetic construct: hsa-miR-3655
gcuugucgcugcgguguugcu

SEQ ID NO: 1015 - RNA, 21 nt, Artificial Sequence
  Synthetic construct: hsa-miR-3655
caacaccgcagcgacaagcuu

SEQ ID NO: 1016 - RNA, 17 nt, Artificial Sequence
  Synthetic construct: hsa-miR-3656
ggcgggugcgggggugg

SEQ ID NO: 1017 - RNA, 17 nt, Artificial Sequence
  Synthetic construct: hsa-miR-3656
acccccgcacccgccuu

SEQ ID NO: 1018 - RNA, 21 nt, Artificial Sequence
  Synthetic construct: hsa-miR-3657
ugugucccauuauuggugauu

SEQ ID NO: 1019 - RNA, 21 nt, Artificial Sequence
  Synthetic construct: hsa-miR-3657
ucaccaauaaugggacacauu

SEQ ID NO: 1020 - RNA, 22 nt, Artificial Sequence
  Synthetic construct: hsa-miR-3658
uuuaagaaaacaccauggagau

SEQ ID NO: 1021 - RNA, 22 nt, Artificial Sequence
  Synthetic construct: hsa-miR-3658
cuccaugguguuuucuuaaauu

SEQ ID NO: 1022 - RNA, 21 nt, Artificial Sequence
  Synthetic construct: hsa-miR-3659
ugaguguugucuacgagggca

SEQ ID NO: 1023 - RNA, 21 nt, Artificial Sequence
  Synthetic construct: hsa-miR-3659
cccucguagacaacacucauu

SEQ ID NO: 1024 - RNA, 22 nt, Artificial Sequence
  Synthetic construct: hsa-miR-365a
uaaugccccuaaaaauccuuau

SEQ ID NO: 1025 - RNA, 23 nt, Artificial Sequence
  Synthetic construct: hsa-miR-365a
agggacuuuugggggcagaugug

SEQ ID NO: 1026 - RNA, 22 nt, Artificial Sequence
  Synthetic construct: hsa-miR-365b
uaaugccccuaaaaauccuuau

SEQ ID NO: 1027 - RNA, 22 nt, Artificial Sequence
  Synthetic construct: hsa-miR-365b
agggacuuucaggggcagcugu

SEQ ID NO: 1028 - RNA, 21 nt, Artificial Sequence
  Synthetic construct: hsa-miR-3660
acugacaggagagcauuuuga

SEQ ID NO: 1029 - RNA, 21 nt, Artificial Sequence
  Synthetic construct: hsa-miR-3660
aaaaugcucuccugucaguuu

SEQ ID NO: 1030 - RNA, 22 nt, Artificial Sequence
  Synthetic construct: hsa-miR-3661
ugaccugggacucggacagcug

SEQ ID NO: 1031 - RNA, 22 nt, Artificial Sequence
  Synthetic construct: hsa-miR-3661
gcuguccgagucccaggucauu

SEQ ID NO: 1032 - RNA, 24 nt, Artificial Sequence
  Synthetic construct: hsa-miR-3662
gaaaaugaugaguagugacugaug

SEQ ID NO: 1033 - RNA, 24 nt, Artificial Sequence
  Synthetic construct: hsa-miR-3662
ucagucacuacucaucauuuucuu

SEQ ID NO: 1034 - RNA, 23 nt, Artificial Sequence
  Synthetic construct: hsa-miR-3663
ugagcaccacacaggccgggcgc

SEQ ID NO: 1035 - RNA, 21 nt, Artificial Sequence
  Synthetic construct: hsa-miR-3663
gcuggucugcguggugcucgg

SEQ ID NO: 1036 - RNA, 22 nt, Artificial Sequence
  Synthetic construct: hsa-miR-3664
ucucaggaguaaagacagaguu

SEQ ID NO: 1037 - RNA, 22 nt, Artificial Sequence
  Synthetic construct: hsa-miR-3664
aacucugucuucacucaugagu

SEQ ID NO: 1038 - RNA, 18 nt, Artificial Sequence
  Synthetic construct: hsa-miR-3665
agcaggugcggggcggcg

SEQ ID NO: 1039 - RNA, 18 nt, Artificial Sequence
  Synthetic construct: hsa-miR-3665
ccgccccgcaccugcuuu

SEQ ID NO: 1040 - RNA, 21 nt, Artificial Sequence
  Synthetic construct: hsa-miR-3666
cagugcaaguguagaugccga

SEQ ID NO: 1041 - RNA, 21 nt, Artificial Sequence
  Synthetic construct: hsa-miR-3666
ggcaucuacacuugcacuguu

SEQ ID NO: 1042 - RNA, 22 nt, Artificial Sequence
  Synthetic construct: hsa-miR-3667
accuuccucuccaugggucuuu

SEQ ID NO: 1043 - RNA, 22 nt, Artificial Sequence
  Synthetic construct: hsa-miR-3667
aaagacccauugaggagaaggu

SEQ ID NO: 1044 - RNA, 21 nt, Artificial Sequence
  Synthetic construct: hsa-miR-3668
aauguagagauugaucaaaau

SEQ ID NO: 1045 - RNA, 21 nt, Artificial Sequence
  Synthetic construct: hsa-miR-3668
uuugaucaaucucuacauuuu

SEQ ID NO: 1046 - RNA, 22 nt, Artificial Sequence
  Synthetic construct: hsa-miR-367
aauugcacuuuagcaaugguga

SEQ ID NO: 1047 - RNA, 22 nt, Artificial Sequence
  Synthetic construct: hsa-miR-367
acuguugcuaauaugcaacucu

SEQ ID NO: 1048 - RNA, 24 nt, Artificial Sequence
  Synthetic construct: hsa-miR-3670
agagcucacagcuguccuucucua

SEQ ID NO: 1049 - RNA, 24 nt, Artificial Sequence
  Synthetic construct: hsa-miR-3670
gagaaggacagcugugagcucuuu

SEQ ID NO: 1050 - RNA, 22 nt, Artificial Sequence
  Synthetic construct: hsa-miR-3671
aucaaauaaggacuagucugca

SEQ ID NO: 1051 - RNA, 22 nt, Artificial Sequence
  Synthetic construct: hsa-miR-3671
cagacuaguccuuauuugauuu

SEQ ID NO: 1052 - RNA, 23 nt, Artificial Sequence
  Synthetic construct: hsa-miR-3672
augagacucauguaaaacaucuu

SEQ ID NO: 1053 - RNA, 23 nt, Artificial Sequence
  Synthetic construct: hsa-miR-3672
gauguuuuacaugagucucauuu

SEQ ID NO: 1054 - RNA, 22 nt, Artificial Sequence
  Synthetic construct: hsa-miR-3674
auuguagaaccuaagauuggcc

SEQ ID NO: 1055 - RNA, 22 nt, Artificial Sequence
  Synthetic construct: hsa-miR-3674
ccaaucuuagguucuacaauuu

SEQ ID NO: 1056 - RNA, 22 nt, Artificial Sequence
  Synthetic construct: hsa-miR-3675
caucucuaaggaacucccccaa

SEQ ID NO: 1057 - RNA, 23 nt, Artificial Sequence
  Synthetic construct: hsa-miR-3675
uauggggcuucuguagagauuuc

SEQ ID NO: 1058 - RNA, 22 nt, Artificial Sequence
  Synthetic construct: hsa-miR-3677
caguggccagagcccugcagug

SEQ ID NO: 1059 - RNA, 22 nt, Artificial Sequence
  Synthetic construct: hsa-miR-3677
cucgugggcucuggccacggcc

SEQ ID NO: 1060 - RNA, 22 nt, Artificial Sequence
  Synthetic construct: hsa-miR-3678
cugcagaguuuguacggaccgg

SEQ ID NO: 1061 - RNA, 20 nt, Artificial Sequence
  Synthetic construct: hsa-miR-3678
uccguacaaacucugcugug

SEQ ID NO: 1062 - RNA, 22 nt, Artificial Sequence
  Synthetic construct: hsa-miR-3679
cuuccccccaguaaucuucauc

SEQ ID NO: 1063 - RNA, 23 nt, Artificial Sequence
  Synthetic construct: hsa-miR-3679
ugaggauauggcagggaagggga

SEQ ID NO: 1064 - RNA, 22 nt, Artificial Sequence
  Synthetic construct: hsa-miR-3680
gacucacucacaggauugugca

SEQ ID NO: 1065 - RNA, 23 nt, Artificial Sequence
  Synthetic construct: hsa-miR-3680
uuuugcaugacccugggaguagg

SEQ ID NO: 1066 - RNA, 22 nt, Artificial Sequence
  Synthetic construct: hsa-miR-3681
uaguggaugaugcacucugugc

SEQ ID NO: 1067 - RNA, 22 nt, Artificial Sequence
  Synthetic construct: hsa-miR-3681
acacagugcuucauccacuacu

SEQ ID NO: 1068 - RNA, 22 nt, Artificial Sequence
  Synthetic construct: hsa-miR-3682
cuacuucuaccuguguuaucau

SEQ ID NO: 1069 - RNA, 21 nt, Artificial Sequence
  Synthetic construct: hsa-miR-3682
ugaugauacagguggagguag

SEQ ID NO: 1070 - RNA, 22 nt, Artificial Sequence
  Synthetic construct: hsa-miR-3683
ugcgacauuggaaguaguauca

SEQ ID NO: 1071 - RNA, 22 nt, Artificial Sequence
  Synthetic construct: hsa-miR-3683
auacuacuuccaaugucgcauu

SEQ ID NO: 1072 - RNA, 21 nt, Artificial Sequence
  Synthetic construct: hsa-miR-3684
uuagaccuaguacacguccuu

SEQ ID NO: 1073 - RNA, 21 nt, Artificial Sequence
  Synthetic construct: hsa-miR-3684
ggacguguacuaggucuaauu

SEQ ID NO: 1074 - RNA, 22 nt, Artificial Sequence
  Synthetic construct: hsa-miR-3685
uuuccuacccuaccugaagacu

SEQ ID NO: 1075 - RNA, 22 nt, Artificial Sequence
  Synthetic construct: hsa-miR-3685
ucuucagguaggguaggaaauu

SEQ ID NO: 1076 - RNA, 22 nt, Artificial Sequence
  Synthetic construct: hsa-miR-3686
aucuguaagagaaaguaaauga

SEQ ID NO: 1077 - RNA, 22 nt, Artificial Sequence
  Synthetic construct: hsa-miR-3686
auuuacuuucucuuacagauuu

SEQ ID NO: 1078 - RNA, 24 nt, Artificial Sequence
  Synthetic construct: hsa-miR-3687
cccggacaggcguucgugcgacgu

SEQ ID NO: 1079 - RNA, 24 nt, Artificial Sequence
  Synthetic construct: hsa-miR-3687
gucgcacgaacgccuguccggguu

SEQ ID NO: 1080 - RNA, 22 nt, Artificial Sequence
  Synthetic construct: hsa-miR-3688
uauggaaagacuuugccacucu

SEQ ID NO: 1081 - RNA, 21 nt, Artificial Sequence
  Synthetic construct: hsa-miR-3688
aguggcaaagucuuuccauau

SEQ ID NO: 1082 - RNA, 22 nt, Artificial Sequence
  Synthetic construct: hsa-miR-3689a
cugggaggugugauaucguggu

SEQ ID NO: 1083 - RNA, 22 nt, Artificial Sequence
  Synthetic construct: hsa-miR-3689a
ugugauaucaugguuccuggga

SEQ ID NO: 1084 - RNA, 22 nt, Artificial Sequence
  Synthetic construct: hsa-miR-3689b
cugggaggugugauauuguggu

SEQ ID NO: 1085 - RNA, 22 nt, Artificial Sequence
  Synthetic construct: hsa-miR-3689b
ugugauaucaugguuccuggga

SEQ ID NO: 1086 - RNA, 22 nt, Artificial Sequence
  Synthetic construct: hsa-miR-3689c
cugggaggugugauauuguggu

SEQ ID NO: 1087 - RNA, 22 nt, Artificial Sequence
  Synthetic construct: hsa-miR-3689c
cacaauaucacaccucccaguu

SEQ ID NO: 1088 - RNA, 22 nt, Artificial Sequence
  Synthetic construct: hsa-miR-3689d
gggaggugugaucucacacucg

SEQ ID NO: 1089 - RNA, 22 nt, Artificial Sequence
  Synthetic construct: hsa-miR-3689d
agugugagaucacaccucccuu

SEQ ID NO: 1090 - RNA, 22 nt, Artificial Sequence
  Synthetic construct: hsa-miR-3689e
ugugauaucaugguuccuggga

SEQ ID NO: 1091 - RNA, 22 nt, Artificial Sequence
  Synthetic construct: hsa-miR-3689e
ccaggaaccaugauaucacauu

SEQ ID NO: 1092 - RNA, 22 nt, Artificial Sequence
  Synthetic construct: hsa-miR-3689f
ugugauaucgugcuuccuggga

SEQ ID NO: 1093 - RNA, 22 nt, Artificial Sequence
  Synthetic construct: hsa-miR-3689f
ccaggaagcacgauaucacauu

SEQ ID NO: 1094 - RNA, 21 nt, Artificial Sequence
  Synthetic construct: hsa-miR-369
aauaauacaugguugaucuuu

SEQ ID NO: 1095 - RNA, 22 nt, Artificial Sequence
  Synthetic construct: hsa-miR-369
agaucgaccguguuauauucgc

SEQ ID NO: 1096 - RNA, 23 nt, Artificial Sequence
  Synthetic construct: hsa-miR-3690
accuggacccagcguagacaaag

SEQ ID NO: 1097 - RNA, 23 nt, Artificial Sequence
  Synthetic construct: hsa-miR-3690
uugucuacgcuggguccagguuu

SEQ ID NO: 1098 - RNA, 23 nt, Artificial Sequence
  Synthetic construct: hsa-miR-3691
aguggaugauggagacucgguac

SEQ ID NO: 1099 - RNA, 22 nt, Artificial Sequence
  Synthetic construct: hsa-miR-3691
accaagucugcgucauccucuc

SEQ ID NO: 1100 - RNA, 24 nt, Artificial Sequence
  Synthetic construct: hsa-miR-3692
guuccacacugacacugcagaagu

SEQ ID NO: 1101 - RNA, 24 nt, Artificial Sequence
  Synthetic construct: hsa-miR-3692
ccugcuggucaggaguggauacug

SEQ ID NO: 1102 - RNA, 22 nt, Artificial Sequence
  Synthetic construct: hsa-miR-370
gccugcugggguggaaccuggu

SEQ ID NO: 1103 - RNA, 22 nt, Artificial Sequence
  Synthetic construct: hsa-miR-370
caggucacgucucugcaguuac

SEQ ID NO: 1104 - RNA, 20 nt, Artificial Sequence
  Synthetic construct: hsa-miR-3713
gguauccguuuggggauggu

SEQ ID NO: 1105 - RNA, 20 nt, Artificial Sequence
  Synthetic construct: hsa-miR-3713
cauccccaaacggauaccuu

SEQ ID NO: 1106 - RNA, 22 nt, Artificial Sequence
  Synthetic construct: hsa-miR-3714
gaaggcagcagugcuccccugu

SEQ ID NO: 1107 - RNA, 22 nt, Artificial Sequence
  Synthetic construct: hsa-miR-3714
aggggagcacugcugccuucuu

SEQ ID NO: 1108 - RNA, 20 nt, Artificial Sequence
  Synthetic construct: hsa-miR-371a
acucaaacugugggggcacu

SEQ ID NO: 1109 - RNA, 23 nt, Artificial Sequence
  Synthetic construct: hsa-miR-371a
aagugccgccaucuuuugagugu

SEQ ID NO: 1110 - RNA, 22 nt, Artificial Sequence
  Synthetic construct: hsa-miR-371b
acucaaaagauggcggcacuuu

SEQ ID NO: 1111 - RNA, 23 nt, Artificial Sequence
  Synthetic construct: hsa-miR-371b
aagugcccccacaguuugagugc

SEQ ID NO: 1112 - RNA, 23 nt, Artificial Sequence
  Synthetic construct: hsa-miR-372
ccucaaauguggagcacuauucu

SEQ ID NO: 1113 - RNA, 23 nt, Artificial Sequence
  Synthetic construct: hsa-miR-372
aaagugcugcgacauuugagcgu

SEQ ID NO: 1114 - RNA, 23 nt, Artificial Sequence
  Synthetic construct: hsa-miR-373
gaagugcuucgauuuuggggugu

SEQ ID NO: 1115 - RNA, 22 nt, Artificial Sequence
  Synthetic construct: hsa-miR-373
acucaaaaugggggcgcuuucc

SEQ ID NO: 1116 - RNA, 22 nt, Artificial Sequence
  Synthetic construct: hsa-miR-374a
uuauaauacaaccugauaagug

SEQ ID NO: 1117 - RNA, 22 nt, Artificial Sequence
  Synthetic construct: hsa-miR-374a
cuuaucagauuguauuguaauu

SEQ ID NO: 1118 - RNA, 22 nt, Artificial Sequence
  Synthetic construct: hsa-miR-374b
cuuagcagguuguauuaucauu

SEQ ID NO: 1119 - RNA, 22 nt, Artificial Sequence
  Synthetic construct: hsa-miR-374b
auauaauacaaccugcuaagug

SEQ ID NO: 1120 - RNA, 22 nt, Artificial Sequence
  Synthetic construct: hsa-miR-374c
cacuuagcagguuguauuauau

SEQ ID NO: 1121 - RNA, 22 nt, Artificial Sequence
  Synthetic construct: hsa-miR-374c
auaauacaaccugcuaagugcu

SEQ ID NO: 1122 - RNA, 22 nt, Artificial Sequence
  Synthetic construct: hsa-miR-375
uuuguucguucggcucgcguga

SEQ ID NO: 1123 - RNA, 22 nt, Artificial Sequence
  Synthetic construct: hsa-miR-375
acgcgagccgaacgaacaaauu

SEQ ID NO: 1124 - RNA, 21 nt, Artificial Sequence
  Synthetic construct: hsa-miR-376a-1
aucauagaggaaaauccacgu

SEQ ID NO: 1125 - RNA, 22 nt, Artificial Sequence
  Synthetic construct: hsa-miR-376a-1
guagauucuccuucuaugagua

SEQ ID NO: 1126 - RNA, 21 nt, Artificial Sequence
  Synthetic construct: hsa-miR-376a-2
aucauagaggaaaauccacgu

SEQ ID NO: 1127 - RNA, 21 nt, Artificial Sequence
  Synthetic construct: hsa-miR-376a-2
gguagauuuuccuucuauggu

SEQ ID NO: 1128 - RNA, 22 nt, Artificial Sequence
  Synthetic construct: hsa-miR-376b
cguggauauuccuucuauguuu

SEQ ID NO: 1129 - RNA, 22 nt, Artificial Sequence
  Synthetic construct: hsa-miR-376b
aucauagaggaaaauccauguu

SEQ ID NO: 1130 - RNA, 21 nt, Artificial Sequence
  Synthetic construct: hsa-miR-376c
gguggauauuccuucuauguu

SEQ ID NO: 1131 - RNA, 21 nt, Artificial Sequence
  Synthetic construct: hsa-miR-376c
aacauagaggaaauuccacgu

SEQ ID NO: 1132 - RNA, 22 nt, Artificial Sequence
  Synthetic construct: hsa-miR-377
agagguugcccuuggugaauuc

SEQ ID NO: 1133 - RNA, 22 nt, Artificial Sequence
  Synthetic construct: hsa-miR-377
aucacacaaaggcaacuuuugu

SEQ ID NO: 1134 - RNA, 22 nt, Artificial Sequence
  Synthetic construct: hsa-miR-378a
cuccugacuccagguccugugu

SEQ ID NO: 1135 - RNA, 22 nt, Artificial Sequence
  Synthetic construct: hsa-miR-378a
acuggacuuggagucagaaggc

SEQ ID NO: 1136 - RNA, 19 nt, Artificial Sequence
  Synthetic construct: hsa-miR-378b
acuggacuuggaggcagaa

SEQ ID NO: 1137 - RNA, 19 nt, Artificial Sequence
  Synthetic construct: hsa-miR-378b
cugccuccaaguccaguuu

SEQ ID NO: 1138 - RNA, 25 nt, Artificial Sequence
  Synthetic construct: hsa-miR-378c
acuggacuuggagucagaagagugg

SEQ ID NO: 1139 - RNA, 25 nt, Artificial Sequence
  Synthetic construct: hsa-miR-378c
acucuucugacuccaaguccaguuu

SEQ ID NO: 1140 - RNA, 20 nt, Artificial Sequence
  Synthetic construct: hsa-miR-378d
acuggacuuggagucagaaa

SEQ ID NO: 1141 - RNA, 20 nt, Artificial Sequence
  Synthetic construct: hsa-miR-378d
ucugacuccaaguccaguuu

SEQ ID NO: 1142 - RNA, 19 nt, Artificial Sequence
  Synthetic construct: hsa-miR-378e
acuggacuuggagucagga

SEQ ID NO: 1143 - RNA, 19 nt, Artificial Sequence
  Synthetic construct: hsa-miR-378e
cugacuccaaguccaguuu

SEQ ID NO: 1144 - RNA, 20 nt, Artificial Sequence
  Synthetic construct: hsa-miR-378f
acuggacuuggagccagaag

SEQ ID NO: 1145 - RNA, 20 nt, Artificial Sequence
  Synthetic construct: hsa-miR-378f
ucuggcuccaaguccaguuu

SEQ ID NO: 1146 - RNA, 20 nt, Artificial Sequence
  Synthetic construct: hsa-miR-378g
acugggcuuggagucagaag

SEQ ID NO: 1147 - RNA, 20 nt, Artificial Sequence
  Synthetic construct: hsa-miR-378g
ucugacuccaagcccaguuu

SEQ ID NO: 1148 - RNA, 21 nt, Artificial Sequence
  Synthetic construct: hsa-miR-378h
acuggacuuggugucagaugg

SEQ ID NO: 1149 - RNA, 21 nt, Artificial Sequence
  Synthetic construct: hsa-miR-378h
aucugacaccaaguccaguuu

SEQ ID NO: 1150 - RNA, 21 nt, Artificial Sequence
  Synthetic construct: hsa-miR-378i
acuggacuaggagucagaagg

SEQ ID NO: 1151 - RNA, 21 nt, Artificial Sequence
  Synthetic construct: hsa-miR-378i
uucugacuccuaguccaguuu

SEQ ID NO: 1152 - RNA, 19 nt, Artificial Sequence
  Synthetic construct: hsa-miR-378j
acuggauuuggagccagaa

SEQ ID NO: 1153 - RNA, 19 nt, Artificial Sequence
  Synthetic construct: hsa-miR-378j
cuggcuccaaauccaguuu

SEQ ID NO: 1154 - RNA, 21 nt, Artificial Sequence
  Synthetic construct: hsa-miR-379
ugguagacuauggaacguagg

SEQ ID NO: 1155 - RNA, 22 nt, Artificial Sequence
  Synthetic construct: hsa-miR-379
uauguaacaugguccacuaacu

SEQ ID NO: 1156 - RNA, 22 nt, Artificial Sequence
  Synthetic construct: hsa-miR-380
ugguugaccauagaacaugcgc

SEQ ID NO: 1157 - RNA, 22 nt, Artificial Sequence
  Synthetic construct: hsa-miR-380
uauguaauaugguccacaucuu

SEQ ID NO: 1158 - RNA, 22 nt, Artificial Sequence
  Synthetic construct: hsa-miR-381
agcgagguugcccuuuguauau

SEQ ID NO: 1159 - RNA, 22 nt, Artificial Sequence
  Synthetic construct: hsa-miR-381
uauacaagggcaagcucucugu

SEQ ID NO: 1160 - RNA, 21 nt, Artificial Sequence
  Synthetic construct: hsa-miR-382
aaucauucacggacaacacuu

SEQ ID NO: 1161 - RNA, 22 nt, Artificial Sequence
  Synthetic construct: hsa-miR-382
gaaguuguucgugguggauucg

SEQ ID NO: 1162 - RNA, 19 nt, Artificial Sequence
  Synthetic construct: hsa-miR-383
acagcacugccuggucaga

SEQ ID NO: 1163 - RNA, 22 nt, Artificial Sequence
  Synthetic construct: hsa-miR-383
agaucagaaggugauuguggcu

SEQ ID NO: 1164 - RNA, 20 nt, Artificial Sequence
  Synthetic construct: hsa-miR-384
auuccuagaaauuguucaua

SEQ ID NO: 1165 - RNA, 20 nt, Artificial Sequence
  Synthetic construct: hsa-miR-384
ugaacaauuucuaggaauuu

SEQ ID NO: 1166 - RNA, 22 nt, Artificial Sequence
  Synthetic construct: hsa-miR-3907
aggugcuccaggcuggcucaca

SEQ ID NO: 1167 - RNA, 22 nt, Artificial Sequence
  Synthetic construct: hsa-miR-3907
ugagccagccuggagcaccuuu

SEQ ID NO: 1168 - RNA, 22 nt, Artificial Sequence
  Synthetic construct: hsa-miR-3908
gagcaauguagguagacuguuu

SEQ ID NO: 1169 - RNA, 22 nt, Artificial Sequence
  Synthetic construct: hsa-miR-3908
acagucuaccuacauugcucuu

SEQ ID NO: 1170 - RNA, 22 nt, Artificial Sequence
  Synthetic construct: hsa-miR-3909
uguccucuagggccugcagucu

SEQ ID NO: 1171 - RNA, 22 nt, Artificial Sequence
  Synthetic construct: hsa-miR-3909
acugcaggcccuagaggacauu

SEQ ID NO: 1172 - RNA, 20 nt, Artificial Sequence
  Synthetic construct: hsa-miR-3910
aaaggcauaaaaccaagaca

SEQ ID NO: 1173 - RNA, 20 nt, Artificial Sequence
  Synthetic construct: hsa-miR-3910
ucuugguuuuaugccuuuuu

SEQ ID NO: 1174 - RNA, 22 nt, Artificial Sequence
  Synthetic construct: hsa-miR-3911
uguguggauccuggaggaggca

SEQ ID NO: 1175 - RNA, 22 nt, Artificial Sequence
  Synthetic construct: hsa-miR-3911
ccuccuccaggauccacacauu

SEQ ID NO: 1176 - RNA, 21 nt, Artificial Sequence
  Synthetic construct: hsa-miR-3912
uaacgcauaauauggacaugu

SEQ ID NO: 1177 - RNA, 21 nt, Artificial Sequence
  Synthetic construct: hsa-miR-3912
auguccauauuauggguuagu

SEQ ID NO: 1178 - RNA, 22 nt, Artificial Sequence
  Synthetic construct: hsa-miR-3913
uuugggacugaucuugaugucu

SEQ ID NO: 1179 - RNA, 22 nt, Artificial Sequence
  Synthetic construct: hsa-miR-3913
agacaucaagaucagucccaaa

SEQ ID NO: 1180 - RNA, 22 nt, Artificial Sequence
  Synthetic construct: hsa-miR-3914
aaggaaccagaaaaugagaagu

SEQ ID NO: 1181 - RNA, 22 nt, Artificial Sequence
  Synthetic construct: hsa-miR-3914
uucucauuuucugguuccuuuu

SEQ ID NO: 1182 - RNA, 22 nt, Artificial Sequence
  Synthetic construct: hsa-miR-3915
uugaggaaaagauggucuuauu

SEQ ID NO: 1183 - RNA, 22 nt, Artificial Sequence
  Synthetic construct: hsa-miR-3915
uaagaccaucuuuuccucaauu

SEQ ID NO: 1184 - RNA, 26 nt, Artificial Sequence
  Synthetic construct: hsa-miR-3916
aagaggaagaaauggcugguucucag

SEQ ID NO: 1185 - RNA, 26 nt, Artificial Sequence
  Synthetic construct: hsa-miR-3916
gagaaccagccauuucuuccucuuuu

SEQ ID NO: 1186 - RNA, 20 nt, Artificial Sequence
  Synthetic construct: hsa-miR-3917
gcucggacugagcagguggg

SEQ ID NO: 1187 - RNA, 20 nt, Artificial Sequence
  Synthetic construct: hsa-miR-3917
caccugcucaguccgagcuu

SEQ ID NO: 1188 - RNA, 21 nt, Artificial Sequence
  Synthetic construct: hsa-miR-3918
acagggccgcagauggagacu

SEQ ID NO: 1189 - RNA, 21 nt, Artificial Sequence
  Synthetic construct: hsa-miR-3918
ucuccaucugcggcccuguuu

SEQ ID NO: 1190 - RNA, 21 nt, Artificial Sequence
  Synthetic construct: hsa-miR-3919
gcagagaacaaaggacucagu

SEQ ID NO: 1191 - RNA, 21 nt, Artificial Sequence
  Synthetic construct: hsa-miR-3919
ugaguccuuuguucucugcuu

SEQ ID NO: 1192 - RNA, 22 nt, Artificial Sequence
  Synthetic construct: hsa-miR-3920
acugauuaucuuaacucucuga

SEQ ID NO: 1193 - RNA, 22 nt, Artificial Sequence
  Synthetic construct: hsa-miR-3920
agagaguuaagauaaucaguuu

SEQ ID NO: 1194 - RNA, 23 nt, Artificial Sequence
  Synthetic construct: hsa-miR-3921
ucucugaguaccauaugccuugu

SEQ ID NO: 1195 - RNA, 23 nt, Artificial Sequence
  Synthetic construct: hsa-miR-3921
aaggcauaugguacucagagauu

SEQ ID NO: 1196 - RNA, 22 nt, Artificial Sequence
  Synthetic construct: hsa-miR-3922
ucuggccuugacuugacucuuu

SEQ ID NO: 1197 - RNA, 23 nt, Artificial Sequence
  Synthetic construct: hsa-miR-3922
ucaaggccagaggucccacagca

SEQ ID NO: 1198 - RNA, 22 nt, Artificial Sequence
  Synthetic construct: hsa-miR-3923
aacuaguaauguuggauuaggg

SEQ ID NO: 1199 - RNA, 22 nt, Artificial Sequence
  Synthetic construct: hsa-miR-3923
cuaauccaacauuacuaguuuu

SEQ ID NO: 1200 - RNA, 22 nt, Artificial Sequence
  Synthetic construct: hsa-miR-3924
auauguauaugugacugcuacu

SEQ ID NO: 1201 - RNA, 22 nt, Artificial Sequence
  Synthetic construct: hsa-miR-3924
uagcagucacauauacauauuu

SEQ ID NO: 1202 - RNA, 22 nt, Artificial Sequence
  Synthetic construct: hsa-miR-3925
aagagaacugaaaguggagccu

SEQ ID NO: 1203 - RNA, 21 nt, Artificial Sequence
  Synthetic construct: hsa-miR-3925
acuccaguuuuaguucucuug

SEQ ID NO: 1204 - RNA, 21 nt, Artificial Sequence
  Synthetic construct: hsa-miR-3926
uggccaaaaagcaggcagaga

SEQ ID NO: 1205 - RNA, 21 nt, Artificial Sequence
  Synthetic construct: hsa-miR-3926
ucugccugcuuuuuggccauu

SEQ ID NO: 1206 - RNA, 22 nt, Artificial Sequence
  Synthetic construct: hsa-miR-3927
cagguagauauuugauaggcau

SEQ ID NO: 1207 - RNA, 21 nt, Artificial Sequence
  Synthetic construct: hsa-miR-3927
gccuaucacauaucugccugu

SEQ ID NO: 1208 - RNA, 23 nt, Artificial Sequence
  Synthetic construct: hsa-miR-3928
ugaagcucuaagguuccgccugc

SEQ ID NO: 1209 - RNA, 22 nt, Artificial Sequence
  Synthetic construct: hsa-miR-3928
ggaggaaccuuggagcuucggc

SEQ ID NO: 1210 - RNA, 23 nt, Artificial Sequence
  Synthetic construct: hsa-miR-3929
gaggcugaugugaguagaccacu

SEQ ID NO: 1211 - RNA, 23 nt, Artificial Sequence
  Synthetic construct: hsa-miR-3929
uggucuacucacaucagccucuu

SEQ ID NO: 1212 - RNA, 22 nt, Artificial Sequence
  Synthetic construct: hsa-miR-3934
ucagguguggaaacugaggcag

SEQ ID NO: 1213 - RNA, 22 nt, Artificial Sequence
  Synthetic construct: hsa-miR-3934
ugcucagguugcacagcuggga

SEQ ID NO: 1214 - RNA, 22 nt, Artificial Sequence
  Synthetic construct: hsa-miR-3935
uguagauacgagcaccagccac

SEQ ID NO: 1215 - RNA, 22 nt, Artificial Sequence
  Synthetic construct: hsa-miR-3935
ggcuggugcucguaucuacauu

SEQ ID NO: 1216 - RNA, 22 nt, Artificial Sequence
  Synthetic construct: hsa-miR-3936
uaagggguguauggcagaugca

SEQ ID NO: 1217 - RNA, 22 nt, Artificial Sequence
  Synthetic construct: hsa-miR-3936
caucugccauacaccccuuauu

SEQ ID NO: 1218 - RNA, 23 nt, Artificial Sequence
  Synthetic construct: hsa-miR-3937
acaggcggcuguagcaauggggg

SEQ ID NO: 1219 - RNA, 23 nt, Artificial Sequence
  Synthetic construct: hsa-miR-3937
cccauugcuacagccgccuguuu

SEQ ID NO: 1220 - RNA, 22 nt, Artificial Sequence
  Synthetic construct: hsa-miR-3938
aauucccuuguagauaacccgg

SEQ ID NO: 1221 - RNA, 22 nt, Artificial Sequence
  Synthetic construct: hsa-miR-3938
ggguuaucuacaagggaauuuu

SEQ ID NO: 1222 - RNA, 22 nt, Artificial Sequence
  Synthetic construct: hsa-miR-3939
uacgcgcagaccacaggauguc

SEQ ID NO: 1223 - RNA, 22 nt, Artificial Sequence
  Synthetic construct: hsa-miR-3939
cauccuguggucugcgcguauu

SEQ ID NO: 1224 - RNA, 20 nt, Artificial Sequence
  Synthetic construct: hsa-miR-3940
guggguuggggcgggcucug

SEQ ID NO: 1225 - RNA, 22 nt, Artificial Sequence
  Synthetic construct: hsa-miR-3940
cagcccggaucccagcccacuu

SEQ ID NO: 1226 - RNA, 22 nt, Artificial Sequence
  Synthetic construct: hsa-miR-3941
uuacacacaacugaggaucaua

SEQ ID NO: 1227 - RNA, 22 nt, Artificial Sequence
  Synthetic construct: hsa-miR-3941
ugauccucaguuguguguaauu

SEQ ID NO: 1228 - RNA, 22 nt, Artificial Sequence
  Synthetic construct: hsa-miR-3942
aagcaauacuguuaccugaaau

SEQ ID NO: 1229 - RNA, 21 nt, Artificial Sequence
  Synthetic construct: hsa-miR-3942
uuucagauaacaguauuacau

SEQ ID NO: 1230 - RNA, 23 nt, Artificial Sequence
  Synthetic construct: hsa-miR-3943
uagcccccaggcuucacuuggcg

SEQ ID NO: 1231 - RNA, 23 nt, Artificial Sequence
  Synthetic construct: hsa-miR-3943
ccaagugaagccugggggcuauu

SEQ ID NO: 1232 - RNA, 23 nt, Artificial Sequence
  Synthetic construct: hsa-miR-3944
uucgggcuggccugcugcuccgg

SEQ ID NO: 1233 - RNA, 21 nt, Artificial Sequence
  Synthetic construct: hsa-miR-3944
ugugcagcaggccaaccgaga

SEQ ID NO: 1234 - RNA, 23 nt, Artificial Sequence
  Synthetic construct: hsa-miR-3945
agggcauaggagaggguugauau

SEQ ID NO: 1235 - RNA, 23 nt, Artificial Sequence
  Synthetic construct: hsa-miR-3945
aucaacccucuccuaugcccuuu

SEQ ID NO: 1236 - RNA, 20 nt, Artificial Sequence
  Synthetic construct: hsa-miR-3960
ggcggcggcggaggcggggg

SEQ ID NO: 1237 - RNA, 20 nt, Artificial Sequence
  Synthetic construct: hsa-miR-3960
cccgccuccgccgccgccuu

SEQ ID NO: 1238 - RNA, 22 nt, Artificial Sequence
  Synthetic construct: hsa-miR-3972
cugccagccccguuccagggca

SEQ ID NO: 1239 - RNA, 22 nt, Artificial Sequence
  Synthetic construct: hsa-miR-3972
cccuggaacggggcuggcaguu

SEQ ID NO: 1240 - RNA, 23 nt, Artificial Sequence
  Synthetic construct: hsa-miR-3973
acaaaguacagcauuagccuuag

SEQ ID NO: 1241 - RNA, 23 nt, Artificial Sequence
  Synthetic construct: hsa-miR-3973
aaggcuaaugcuguacuuuguuu

SEQ ID NO: 1242 - RNA, 23 nt, Artificial Sequence
  Synthetic construct: hsa-miR-3974
aaaggucauuguaagguuaaugc

SEQ ID NO: 1243 - RNA, 23 nt, Artificial Sequence
  Synthetic construct: hsa-miR-3974
auuaaccuuacaaugaccuuuuu

SEQ ID NO: 1244 - RNA, 22 nt, Artificial Sequence
  Synthetic construct: hsa-miR-3975
ugaggcuaaugcacuacuucac

SEQ ID NO: 1245 - RNA, 22 nt, Artificial Sequence
  Synthetic construct: hsa-miR-3975
gaaguagugcauuagccucauu

SEQ ID NO: 1246 - RNA, 24 nt, Artificial Sequence
  Synthetic construct: hsa-miR-3976
uauagagagcaggaagauuaaugu

SEQ ID NO: 1247 - RNA, 24 nt, Artificial Sequence
  Synthetic construct: hsa-miR-3976
auuaaucuuccugcucucuauauu

SEQ ID NO: 1248 - RNA, 23 nt, Artificial Sequence
  Synthetic construct: hsa-miR-3977
gugcuucaucguaauuaaccuua

SEQ ID NO: 1249 - RNA, 23 nt, Artificial Sequence
  Synthetic construct: hsa-miR-3977
agguuaauuacgaugaagcacuu

SEQ ID NO: 1250 - RNA, 24 nt, Artificial Sequence
  Synthetic construct: hsa-miR-3978
guggaaagcaugcauccagggugu

SEQ ID NO: 1251 - RNA, 24 nt, Artificial Sequence
  Synthetic construct: hsa-miR-3978
acccuggaugcaugcuuuccacuu

SEQ ID NO: 1252 - RNA, 22 nt, Artificial Sequence
  Synthetic construct: hsa-miR-409
gaauguugcucggugaaccccu

SEQ ID NO: 1253 - RNA, 23 nt, Artificial Sequence
  Synthetic construct: hsa-miR-409
agguuacccgagcaacuuugcau

SEQ ID NO: 1254 - RNA, 21 nt, Artificial Sequence
  Synthetic construct: hsa-miR-410
agguugucugugaugaguucg

SEQ ID NO: 1255 - RNA, 21 nt, Artificial Sequence
  Synthetic construct: hsa-miR-410
aauauaacacagauggccugu

SEQ ID NO: 1256 - RNA, 22 nt, Artificial Sequence
  Synthetic construct: hsa-miR-411
uauguaacacgguccacuaacc

SEQ ID NO: 1257 - RNA, 21 nt, Artificial Sequence
  Synthetic construct: hsa-miR-411
uaguagaccguauagcguacg

SEQ ID NO: 1258 - RNA, 23 nt, Artificial Sequence
  Synthetic construct: hsa-miR-412
uggucgaccaguuggaaaguaau

SEQ ID NO: 1259 - RNA, 23 nt, Artificial Sequence
  Synthetic construct: hsa-miR-412
acuucaccugguccacuagccgu

SEQ ID NO: 1260 - RNA, 23 nt, Artificial Sequence
  Synthetic construct: hsa-miR-421
aucaacagacauuaauugggcgc

SEQ ID NO: 1261 - RNA, 23 nt, Artificial Sequence
  Synthetic construct: hsa-miR-421
gcccaauuaaugucuguugauuu

SEQ ID NO: 1262 - RNA, 22 nt, Artificial Sequence
  Synthetic construct: hsa-miR-422a
acuggacuuagggucagaaggc

SEQ ID NO: 1263 - RNA, 22 nt, Artificial Sequence
  Synthetic construct: hsa-miR-422a
cuucugacccuaaguccaguuu

SEQ ID NO: 1264 - RNA, 23 nt, Artificial Sequence
  Synthetic construct: hsa-miR-423
ugaggggcagagagcgagacuuu

SEQ ID NO: 1265 - RNA, 23 nt, Artificial Sequence
  Synthetic construct: hsa-miR-423
agcucggucugaggccccucagu

SEQ ID NO: 1266 - RNA, 22 nt, Artificial Sequence
  Synthetic construct: hsa-miR-424
cagcagcaauucauguuuugaa

SEQ ID NO: 1267 - RNA, 21 nt, Artificial Sequence
  Synthetic construct: hsa-miR-424
caaaacgugaggcgcugcuau

SEQ ID NO: 1268 - RNA, 22 nt, Artificial Sequence
  Synthetic construct: hsa-miR-425
aucgggaaugucguguccgccc

SEQ ID NO: 1269 - RNA, 23 nt, Artificial Sequence
  Synthetic construct: hsa-miR-425
aaugacacgaucacucccguuga

SEQ ID NO: 1270 - RNA, 17 nt, Artificial Sequence
  Synthetic construct: hsa-miR-4251
ccugagaaaagggccaa

SEQ ID NO: 1271 - RNA, 17 nt, Artificial Sequence
  Synthetic construct: hsa-miR-4251
ggcccuuuucucagguu

SEQ ID NO: 1272 - RNA, 19 nt, Artificial Sequence
  Synthetic construct: hsa-miR-4252
ggccacugagucagcacca

SEQ ID NO: 1273 - RNA, 19 nt, Artificial Sequence
  Synthetic construct: hsa-miR-4252
gugcugacucaguggccuu

SEQ ID NO: 1274 - RNA, 18 nt, Artificial Sequence
  Synthetic construct: hsa-miR-4253
agggcauguccagggggu

SEQ ID NO: 1275 - RNA, 18 nt, Artificial Sequence
  Synthetic construct: hsa-miR-4253
ccccuggacaugcccuuu

SEQ ID NO: 1276 - RNA, 23 nt, Artificial Sequence
  Synthetic construct: hsa-miR-4254
gccuggagcuacuccaccaucuc

SEQ ID NO: 1277 - RNA, 23 nt, Artificial Sequence
  Synthetic construct: hsa-miR-4254
gaugguggaguagcuccaggcuu

SEQ ID NO: 1278 - RNA, 17 nt, Artificial Sequence
  Synthetic construct: hsa-miR-4255
caguguucagagaugga

SEQ ID NO: 1279 - RNA, 17 nt, Artificial Sequence
  Synthetic construct: hsa-miR-4255
caucucugaacacuguu

SEQ ID NO: 1280 - RNA, 18 nt, Artificial Sequence
  Synthetic construct: hsa-miR-4256
aucugaccugaugaaggu

SEQ ID NO: 1281 - RNA, 18 nt, Artificial Sequence
  Synthetic construct: hsa-miR-4256
cuucaucaggucagauuu

SEQ ID NO: 1282 - RNA, 18 nt, Artificial Sequence
  Synthetic construct: hsa-miR-4257
ccagagguggggacugag

SEQ ID NO: 1283 - RNA, 18 nt, Artificial Sequence
  Synthetic construct: hsa-miR-4257
caguccccaccucugguu

SEQ ID NO: 1284 - RNA, 17 nt, Artificial Sequence
  Synthetic construct: hsa-miR-4258
ccccgccaccgccuugg

SEQ ID NO: 1285 - RNA, 17 nt, Artificial Sequence
  Synthetic construct: hsa-miR-4258
aaggcgguggcgggguu

SEQ ID NO: 1286 - RNA, 22 nt, Artificial Sequence
  Synthetic construct: hsa-miR-4259
caguugggucuaggggucagga

SEQ ID NO: 1287 - RNA, 22 nt, Artificial Sequence
  Synthetic construct: hsa-miR-4259
cugaccccuagacccaacuguu

SEQ ID NO: 1288 - RNA, 19 nt, Artificial Sequence
  Synthetic construct: hsa-miR-4260
cuuggggcauggaguccca

SEQ ID NO: 1289 - RNA, 19 nt, Artificial Sequence
  Synthetic construct: hsa-miR-4260
ggacuccaugccccaaguu

SEQ ID NO: 1290 - RNA, 16 nt, Artificial Sequence
  Synthetic construct: hsa-miR-4261
aggaaacagggaccca

SEQ ID NO: 1291 - RNA, 16 nt, Artificial Sequence
  Synthetic construct: hsa-miR-4261
ggucccuguuuccuuu

SEQ ID NO: 1292 - RNA, 17 nt, Artificial Sequence
  Synthetic construct: hsa-miR-4262
gacauucagacuaccug

SEQ ID NO: 1293 - RNA, 17 nt, Artificial Sequence
  Synthetic construct: hsa-miR-4262
gguagucugaaugucuu

SEQ ID NO: 1294 - RNA, 18 nt, Artificial Sequence
  Synthetic construct: hsa-miR-4263
auucuaagugccuuggcc

SEQ ID NO: 1295 - RNA, 18 nt, Artificial Sequence
  Synthetic construct: hsa-miR-4263
ccaaggcacuuagaauuu

SEQ ID NO: 1296 - RNA, 17 nt, Artificial Sequence
  Synthetic construct: hsa-miR-4264
acucagucauggucauu

SEQ ID NO: 1297 - RNA, 17 nt, Artificial Sequence
  Synthetic construct: hsa-miR-4264
ugaccaugacugaguuu

SEQ ID NO: 1298 - RNA, 19 nt, Artificial Sequence
  Synthetic construct: hsa-miR-4265
cugugggcucagcucuggg

SEQ ID NO: 1299 - RNA, 19 nt, Artificial Sequence
  Synthetic construct: hsa-miR-4265
cagagcugagcccacaguu

SEQ ID NO: 1300 - RNA, 16 nt, Artificial Sequence
  Synthetic construct: hsa-miR-4266
cuaggaggccuuggcc

SEQ ID NO: 1301 - RNA, 16 nt, Artificial Sequence
  Synthetic construct: hsa-miR-4266
ccaaggccuccuaguu

SEQ ID NO: 1302 - RNA, 16 nt, Artificial Sequence
  Synthetic construct: hsa-miR-4267
uccagcucgguggcac

SEQ ID NO: 1303 - RNA, 16 nt, Artificial Sequence
  Synthetic construct: hsa-miR-4267
gccaccgagcuggauu

SEQ ID NO: 1304 - RNA, 21 nt, Artificial Sequence
  Synthetic construct: hsa-miR-4268
ggcuccuccucucaggaugug

SEQ ID NO: 1305 - RNA, 21 nt, Artificial Sequence
  Synthetic construct: hsa-miR-4268
cauccugagaggaggagccuu

SEQ ID NO: 1306 - RNA, 21 nt, Artificial Sequence
  Synthetic construct: hsa-miR-4269
gcaggcacagacagcccuggc

SEQ ID NO: 1307 - RNA, 21 nt, Artificial Sequence
  Synthetic construct: hsa-miR-4269
cagggcugucugugccugcuu

SEQ ID NO: 1308 - RNA, 20 nt, Artificial Sequence
  Synthetic construct: hsa-miR-4270
ucagggagucaggggagggc

SEQ ID NO: 1309 - RNA, 20 nt, Artificial Sequence
  Synthetic construct: hsa-miR-4270
ccuccccugacucccugauu

SEQ ID NO: 1310 - RNA, 19 nt, Artificial Sequence
  Synthetic construct: hsa-miR-4271
gggggaagaaaaggugggg

SEQ ID NO: 1311 - RNA, 19 nt, Artificial Sequence
  Synthetic construct: hsa-miR-4271
ccaccuuuucuucccccuu

SEQ ID NO: 1312 - RNA, 18 nt, Artificial Sequence
  Synthetic construct: hsa-miR-4272
cauucaacuagugauugu

SEQ ID NO: 1313 - RNA, 18 nt, Artificial Sequence
  Synthetic construct: hsa-miR-4272
aaucacuaguugaauguu

SEQ ID NO: 1314 - RNA, 18 nt, Artificial Sequence
  Synthetic construct: hsa-miR-4273
guguucucugauggacag

SEQ ID NO: 1315 - RNA, 18 nt, Artificial Sequence
  Synthetic construct: hsa-miR-4273
guccaucagagaacacuu

SEQ ID NO: 1316 - RNA, 18 nt, Artificial Sequence
  Synthetic construct: hsa-miR-4274
cagcagucccucccccug

SEQ ID NO: 1317 - RNA, 18 nt, Artificial Sequence
  Synthetic construct: hsa-miR-4274
gggggagggacugcuguu

SEQ ID NO: 1318 - RNA, 17 nt, Artificial Sequence
  Synthetic construct: hsa-miR-4275
ccaauuaccacuucuuu

SEQ ID NO: 1319 - RNA, 17 nt, Artificial Sequence
  Synthetic construct: hsa-miR-4275
agaagugguaauugguu

SEQ ID NO: 1320 - RNA, 17 nt, Artificial Sequence
  Synthetic construct: hsa-miR-4276
cucagugacucaugugc

SEQ ID NO: 1321 - RNA, 17 nt, Artificial Sequence
  Synthetic construct: hsa-miR-4276
acaugagucacugaguu

SEQ ID NO: 1322 - RNA, 21 nt, Artificial Sequence
  Synthetic construct: hsa-miR-4277
gcaguucugagcacaguacac

SEQ ID NO: 1323 - RNA, 21 nt, Artificial Sequence
  Synthetic construct: hsa-miR-4277
guacugugcucagaacugcuu

SEQ ID NO: 1324 - RNA, 18 nt, Artificial Sequence
  Synthetic construct: hsa-miR-4278
cuaggggguuugcccuug

SEQ ID NO: 1325 - RNA, 18 nt, Artificial Sequence
  Synthetic construct: hsa-miR-4278
agggcaaacccccuaguu

SEQ ID NO: 1326 - RNA, 16 nt, Artificial Sequence
  Synthetic construct: hsa-miR-4279
cucuccucccggcuuc

SEQ ID NO: 1327 - RNA, 16 nt, Artificial Sequence
  Synthetic construct: hsa-miR-4279
agccgggaggagaguu

SEQ ID NO: 1328 - RNA, 21 nt, Artificial Sequence
  Synthetic construct: hsa-miR-4280
gaguguaguucugagcagagc

SEQ ID NO: 1329 - RNA, 21 nt, Artificial Sequence
  Synthetic construct: hsa-miR-4280
ucugcucagaacuacacucuu

SEQ ID NO: 1330 - RNA, 18 nt, Artificial Sequence
  Synthetic construct: hsa-miR-4281
gggucccggggagggggg

SEQ ID NO: 1331 - RNA, 18 nt, Artificial Sequence
  Synthetic construct: hsa-miR-4281
ccccuccccgggacccuu

SEQ ID NO: 1332 - RNA, 18 nt, Artificial Sequence
  Synthetic construct: hsa-miR-4282
uaaaauuugcauccagga

SEQ ID NO: 1333 - RNA, 18 nt, Artificial Sequence
  Synthetic construct: hsa-miR-4282
cuggaugcaaauuuuauu

SEQ ID NO: 1334 - RNA, 17 nt, Artificial Sequence
  Synthetic construct: hsa-miR-4283
uggggcucagcgaguuu

SEQ ID NO: 1335 - RNA, 17 nt, Artificial Sequence
  Synthetic construct: hsa-miR-4283
acucgcugagccccauu

SEQ ID NO: 1336 - RNA, 18 nt, Artificial Sequence
  Synthetic construct: hsa-miR-4284
gggcucacaucaccccau

SEQ ID NO: 1337 - RNA, 18 nt, Artificial Sequence
  Synthetic construct: hsa-miR-4284
ggggugaugugagcccuu

SEQ ID NO: 1338 - RNA, 18 nt, Artificial Sequence
  Synthetic construct: hsa-miR-4285
gcggcgaguccgacucau

SEQ ID NO: 1339 - RNA, 18 nt, Artificial Sequence
  Synthetic construct: hsa-miR-4285
gagucggacucgccgcuu

SEQ ID NO: 1340 - RNA, 17 nt, Artificial Sequence
  Synthetic construct: hsa-miR-4286
accccacuccugguacc

SEQ ID NO: 1341 - RNA, 17 nt, Artificial Sequence
  Synthetic construct: hsa-miR-4286
uaccaggagugggguuu

SEQ ID NO: 1342 - RNA, 19 nt, Artificial Sequence
  Synthetic construct: hsa-miR-4287
ucucccuugagggcacuuu

SEQ ID NO: 1343 - RNA, 19 nt, Artificial Sequence
  Synthetic construct: hsa-miR-4287
agugcccucaagggagauu

SEQ ID NO: 1344 - RNA, 17 nt, Artificial Sequence
  Synthetic construct: hsa-miR-4288
uugucugcugaguuucc

SEQ ID NO: 1345 - RNA, 17 nt, Artificial Sequence
  Synthetic construct: hsa-miR-4288
aaacucagcagacaauu

SEQ ID NO: 1346 - RNA, 19 nt, Artificial Sequence
  Synthetic construct: hsa-miR-4289
gcauugugcagggcuauca

SEQ ID NO: 1347 - RNA, 19 nt, Artificial Sequence
  Synthetic construct: hsa-miR-4289
auagcccugcacaaugcuu

SEQ ID NO: 1348 - RNA, 22 nt, Artificial Sequence
  Synthetic construct: hsa-miR-429
uaauacugucugguaaaaccgu

SEQ ID NO: 1349 - RNA, 22 nt, Artificial Sequence
  Synthetic construct: hsa-miR-429
gguuuuaccagacaguauuauu

SEQ ID NO: 1350 - RNA, 19 nt, Artificial Sequence
  Synthetic construct: hsa-miR-4290
ugcccuccuuucuucccuc

SEQ ID NO: 1351 - RNA, 19 nt, Artificial Sequence
  Synthetic construct: hsa-miR-4290
gggaagaaaggagggcauu

SEQ ID NO: 1352 - RNA, 16 nt, Artificial Sequence
  Synthetic construct: hsa-miR-4291
uucagcaggaacagcu

SEQ ID NO: 1353 - RNA, 16 nt, Artificial Sequence
  Synthetic construct: hsa-miR-4291
cuguuccugcugaauu

SEQ ID NO: 1354 - RNA, 18 nt, Artificial Sequence
  Synthetic construct: hsa-miR-4292
ccccugggccggccuugg

SEQ ID NO: 1355 - RNA, 18 nt, Artificial Sequence
  Synthetic construct: hsa-miR-4292
aaggccggcccagggguu

SEQ ID NO: 1356 - RNA, 17 nt, Artificial Sequence
  Synthetic construct: hsa-miR-4293
cagccugacaggaacag

SEQ ID NO: 1357 - RNA, 17 nt, Artificial Sequence
  Synthetic construct: hsa-miR-4293
guuccugucaggcuguu

SEQ ID NO: 1358 - RNA, 17 nt, Artificial Sequence
  Synthetic construct: hsa-miR-4294
gggagucuacagcaggg

SEQ ID NO: 1359 - RNA, 17 nt, Artificial Sequence
  Synthetic construct: hsa-miR-4294
cugcuguagacucccuu

SEQ ID NO: 1360 - RNA, 18 nt, Artificial Sequence
  Synthetic construct: hsa-miR-4295
cagugcaauguuuuccuu

SEQ ID NO: 1361 - RNA, 18 nt, Artificial Sequence
  Synthetic construct: hsa-miR-4295
ggaaaacauugcacuguu

SEQ ID NO: 1362 - RNA, 17 nt, Artificial Sequence
  Synthetic construct: hsa-miR-4296
augugggcucaggcuca

SEQ ID NO: 1363 - RNA, 17 nt, Artificial Sequence
  Synthetic construct: hsa-miR-4296
agccugagcccacauuu

SEQ ID NO: 1364 - RNA, 16 nt, Artificial Sequence
  Synthetic construct: hsa-miR-4297
ugccuuccugucugug

SEQ ID NO: 1365 - RNA, 16 nt, Artificial Sequence
  Synthetic construct: hsa-miR-4297
cagacaggaaggcauu

SEQ ID NO: 1366 - RNA, 22 nt, Artificial Sequence
  Synthetic construct:
cugggacaggaggaggaggcag

SEQ ID NO: 1367 - RNA, 22 nt, Artificial Sequence
  Synthetic construct: hsa-miR-4298
gccuccuccuccugucccaguu

SEQ ID NO: 1368 - RNA, 18 nt, Artificial Sequence
  Synthetic construct: hsa-miR-4299
gcuggugacaugagaggc

SEQ ID NO: 1369 - RNA, 18 nt, Artificial Sequence
  Synthetic construct: hsa-miR-4299
cucucaugucaccagcuu

SEQ ID NO: 1370 - RNA, 18 nt, Artificial Sequence
  Synthetic construct: hsa-miR-4300
ugggagcuggacuacuuc

SEQ ID NO: 1371 - RNA, 18 nt, Artificial Sequence
  Synthetic construct: hsa-miR-4300
aguaguccagcucccauu

SEQ ID NO: 1372 - RNA, 20 nt, Artificial Sequence
  Synthetic construct: hsa-miR-4301
ucccacuacuucacuuguga

SEQ ID NO: 1373 - RNA, 20 nt, Artificial Sequence
  Synthetic construct: hsa-miR-4301
acaagugaaguagugggauu

SEQ ID NO: 1374 - RNA, 18 nt, Artificial Sequence
  Synthetic construct: hsa-miR-4302
ccaguguggcucagcgag

SEQ ID NO: 1375 - RNA, 18 nt, Artificial Sequence
  Synthetic construct: hsa-miR-4302
cgcugagccacacugguu

SEQ ID NO: 1376 - RNA, 17 nt, Artificial Sequence
  Synthetic construct: hsa-miR-4303
uucugagcugaggacag

SEQ ID NO: 1377 - RNA, 17 nt, Artificial Sequence
  Synthetic construct: hsa-miR-4303
guccucagcucagaauu

SEQ ID NO: 1378 - RNA, 17 nt, Artificial Sequence
  Synthetic construct: hsa-miR-4304
ccggcauguccagggca

SEQ ID NO: 1379 - RNA, 17 nt, Artificial Sequence
  Synthetic construct: hsa-miR-4304
cccuggacaugccgguu

SEQ ID NO: 1380 - RNA, 18 nt, Artificial Sequence
  Synthetic construct: hsa-miR-4305
ccuagacaccuccaguuc

SEQ ID NO: 1381 - RNA, 18 nt, Artificial Sequence
  Synthetic construct: hsa-miR-4305
acuggaggugucuagguu

SEQ ID NO: 1382 - RNA, 17 nt, Artificial Sequence
  Synthetic construct: hsa-miR-4306
uggagagaaaggcagua

SEQ ID NO: 1383 - RNA, 17 nt, Artificial Sequence
  Synthetic construct: hsa-miR-4306
cugccuuucucuccauu

SEQ ID NO: 1384 - RNA, 19 nt, Artificial Sequence
  Synthetic construct: hsa-miR-4307
aauguuuuuuccuguuucc

SEQ ID NO: 1385 - RNA, 19 nt, Artificial Sequence
  Synthetic construct: hsa-miR-4307
aaacaggaaaaaacauuuu

SEQ ID NO: 1386 - RNA, 18 nt, Artificial Sequence
  Synthetic construct: hsa-miR-4308
ucccuggaguuucuucuu

SEQ ID NO: 1387 - RNA, 18 nt, Artificial Sequence
  Synthetic construct: hsa-miR-4308
gaagaaacuccagggauu

SEQ ID NO: 1388 - RNA, 18 nt, Artificial Sequence
  Synthetic construct: hsa-miR-4309
cuggagucuaggauucca

SEQ ID NO: 1389 - RNA, 18 nt, Artificial Sequence
  Synthetic construct: hsa-miR-4309
gaauccuagacuccaguu

SEQ ID NO: 1390 - RNA, 21 nt, Artificial Sequence
  Synthetic construct: hsa-miR-431
ugucuugcaggccgucaugca

SEQ ID NO: 1391 - RNA, 22 nt, Artificial Sequence
  Synthetic construct: hsa-miR-431
caggucgucuugcagggcuucu

SEQ ID NO: 1392 - RNA, 16 nt, Artificial Sequence
  Synthetic construct: hsa-miR-4310
gcagcauucauguccc

SEQ ID NO: 1393 - RNA, 16 nt, Artificial Sequence
  Synthetic construct: hsa-miR-4310
gacaugaaugcugcuu

SEQ ID NO: 1394 - RNA, 18 nt, Artificial Sequence
  Synthetic construct: hsa-miR-4311
gaaagagagcugagugug

SEQ ID NO: 1395 - RNA, 18 nt, Artificial Sequence
  Synthetic construct: hsa-miR-4311
cacucagcucucuuucuu

SEQ ID NO: 1396 - RNA, 19 nt, Artificial Sequence
  Synthetic construct: hsa-miR-4312
ggccuuguuccugucccca

SEQ ID NO: 1397 - RNA, 19 nt, Artificial Sequence
  Synthetic construct: hsa-miR-4312
gggacaggaacaaggccuu

SEQ ID NO: 1398 - RNA, 20 nt, Artificial Sequence
  Synthetic construct: hsa-miR-4313
agcccccuggccccaaaccc

SEQ ID NO: 1399 - RNA, 20 nt, Artificial Sequence
  Synthetic construct: hsa-miR-4313
guuuggggccagggggcuuu

SEQ ID NO: 1400 - RNA, 18 nt, Artificial Sequence
  Synthetic construct: hsa-miR-4314
cucugggaaaugggacag

SEQ ID NO: 1401 - RNA, 18 nt, Artificial Sequence
  Synthetic construct: hsa-miR-4314
gucccauuucccagaguu

SEQ ID NO: 1402 - RNA, 18 nt, Artificial Sequence
  Synthetic construct: hsa-miR-4315
ccgcuuucugagcuggac

SEQ ID NO: 1403 - RNA, 18 nt, Artificial Sequence
  Synthetic construct: hsa-miR-4315
ccagcucagaaagcgguu

SEQ ID NO: 1404 - RNA, 17 nt, Artificial Sequence
  Synthetic construct: hsa-miR-4316
ggugaggcuagcuggug

SEQ ID NO: 1405 - RNA, 17 nt, Artificial Sequence
  Synthetic construct: hsa-miR-4316
ccagcuagccucaccuu

SEQ ID NO: 1406 - RNA, 17 nt, Artificial Sequence
  Synthetic construct: hsa-miR-4317
acauugccagggaguuu

SEQ ID NO: 1407 - RNA, 17 nt, Artificial Sequence
  Synthetic construct: hsa-miR-4317
acucccuggcaauguuu

SEQ ID NO: 1408 - RNA, 17 nt, Artificial Sequence
  Synthetic construct: hsa-miR-4318
cacuguggguacaugcu

SEQ ID NO: 1409 - RNA, 17 nt, Artificial Sequence
  Synthetic construct: hsa-miR-4318
cauguacccacaguguu

SEQ ID NO: 1410 - RNA, 17 nt, Artificial Sequence
  Synthetic construct: hsa-miR-4319
ucccugagcaaagccac

SEQ ID NO: 1411 - RNA, 17 nt, Artificial Sequence
  Synthetic construct: hsa-miR-4319
ggcuuugcucagggauu

SEQ ID NO: 1412 - RNA, 23 nt, Artificial Sequence
  Synthetic construct: hsa-miR-432
ucuuggaguaggucauugggugg

SEQ ID NO: 1413 - RNA, 21 nt, Artificial Sequence
  Synthetic construct: hsa-miR-432
cuggauggcuccuccaugucu

SEQ ID NO: 1414 - RNA, 18 nt, Artificial Sequence
  Synthetic construct: hsa-miR-4320
gggauucuguagcuuccu

SEQ ID NO: 1415 - RNA, 18 nt, Artificial Sequence
  Synthetic construct: hsa-miR-4320
gaagcuacagaaucccuu

SEQ ID NO: 1416 - RNA, 21 nt, Artificial Sequence
  Synthetic construct: hsa-miR-4321
uuagcgguggaccgcccugcg

SEQ ID NO: 1417 - RNA, 21 nt, Artificial Sequence
  Synthetic construct: hsa-miR-4321
cagggcgguccaccgcuaauu

SEQ ID NO: 1418 - RNA, 21 nt, Artificial Sequence
  Synthetic construct: hsa-miR-4322
cugugggcucagcgcgugggg

SEQ ID NO: 1419 - RNA, 21 nt, Artificial Sequence
  Synthetic construct: hsa-miR-4322
ccacgcgcugagcccacaguu

SEQ ID NO: 1420 - RNA, 18 nt, Artificial Sequence
  Synthetic construct: hsa-miR-4323
cagccccacagccucaga

SEQ ID NO: 1421 - RNA, 18 nt, Artificial Sequence
  Synthetic construct: hsa-miR-4323
ugaggcuguggggcuguu

SEQ ID NO: 1422 - RNA, 20 nt, Artificial Sequence
  Synthetic construct: hsa-miR-4324
cccugagacccuaaccuuaa

SEQ ID NO: 1423 - RNA, 20 nt, Artificial Sequence
  Synthetic construct: hsa-miR-4324
aagguuagggucucaggguu

SEQ ID NO: 1424 - RNA, 18 nt, Artificial Sequence
  Synthetic construct: hsa-miR-4325
uugcacuugucucaguga

SEQ ID NO: 1425 - RNA, 18 nt, Artificial Sequence
  Synthetic construct: hsa-miR-4325
acugagacaagugcaauu

SEQ ID NO: 1426 - RNA, 20 nt, Artificial Sequence
  Synthetic construct: hsa-miR-4326
uguuccucugucucccagac

SEQ ID NO: 1427 - RNA, 20 nt, Artificial Sequence
  Synthetic construct: hsa-miR-4326
cugggagacagaggaacauu

SEQ ID NO: 1428 - RNA, 19 nt, Artificial Sequence
  Synthetic construct: hsa-miR-4327
ggcuugcaugggggacugg

SEQ ID NO: 1429 - RNA, 19 nt, Artificial Sequence
  Synthetic construct: hsa-miR-4327
agucccccaugcaagccuu

SEQ ID NO: 1430 - RNA, 17 nt, Artificial Sequence
  Synthetic construct: hsa-miR-4328
ccaguuuucccaggauu

SEQ ID NO: 1431 - RNA, 17 nt, Artificial Sequence
  Synthetic construct: hsa-miR-4328
uccugggaaaacugguu

SEQ ID NO: 1432 - RNA, 19 nt, Artificial Sequence
  Synthetic construct: hsa-miR-4329
ccugagacccuaguuccac

SEQ ID NO: 1433 - RNA, 19 nt, Artificial Sequence
  Synthetic construct: hsa-miR-4329
ggaacuagggucucagguu

SEQ ID NO: 1434 - RNA, 22 nt, Artificial Sequence
  Synthetic construct: hsa-miR-433
uacggugagccugucauuauuc

SEQ ID NO: 1435 - RNA, 22 nt, Artificial Sequence
  Synthetic construct: hsa-miR-433
aucaugaugggcuccucggugu

SEQ ID NO: 1436 - RNA, 19 nt, Artificial Sequence
  Synthetic construct: hsa-miR-4330
ccucagaucagagccuugc

SEQ ID NO: 1437 - RNA, 19 nt, Artificial Sequence
  Synthetic construct: hsa-miR-4330
aaggcucugaucugagguu

SEQ ID NO: 1438 - RNA, 18 nt, Artificial Sequence
  Synthetic construct: hsa-miR-4417
ggugggcuucccggaggg

SEQ ID NO: 1439 - RNA, 18 nt, Artificial Sequence
  Synthetic construct: hsa-miR-4417
cuccgggaagcccaccuu

SEQ ID NO: 1440 - RNA, 18 nt, Artificial Sequence
  Synthetic construct: hsa-miR-4418
cacugcaggacucagcag

SEQ ID NO: 1441 - RNA, 18 nt, Artificial Sequence
  Synthetic construct: hsa-miR-4418
gcugaguccugcaguguu

SEQ ID NO: 1442 - RNA, 17 nt, Artificial Sequence
  Synthetic construct: hsa-miR-4419a
ugagggaggagacugca

SEQ ID NO: 1443 - RNA, 17 nt, Artificial Sequence
  Synthetic construct: hsa-miR-4419a
cagucuccucccucauu

SEQ ID NO: 1444 - RNA, 18 nt, Artificial Sequence
  Synthetic construct: hsa-miR-4419b
gaggcugaaggaagaugg

SEQ ID NO: 1445 - RNA, 18 nt, Artificial Sequence
  Synthetic construct: hsa-miR-4419b
aucuuccuucagccucuu

SEQ ID NO: 1446 - RNA, 22 nt, Artificial Sequence
  Synthetic construct: hsa-miR-4420
gucacugaugucuguagcugag

SEQ ID NO: 1447 - RNA, 22 nt, Artificial Sequence
  Synthetic construct: hsa-miR-4420
cagcuacagacaucagugacuu

SEQ ID NO: 1448 - RNA, 22 nt, Artificial Sequence
  Synthetic construct: hsa-miR-4421
accugucuguggaaaggagcua

SEQ ID NO: 1449 - RNA, 22 nt, Artificial Sequence
  Synthetic construct: hsa-miR-4421
gcuccuuuccacagacagguuu

SEQ ID NO: 1450 - RNA, 21 nt, Artificial Sequence
  Synthetic construct: hsa-miR-4422
aaaagcaucaggaaguaccca

SEQ ID NO: 1451 - RNA, 21 nt, Artificial Sequence
  Synthetic construct: hsa-miR-4422
gguacuuccugaugcuuuuuu

SEQ ID NO: 1452 - RNA, 22 nt, Artificial Sequence
  Synthetic construct: hsa-miR-4423
aguugccuuuuuguucccaugc

SEQ ID NO: 1453 - RNA, 21 nt, Artificial Sequence
  Synthetic construct: hsa-miR-4423
auaggcaccaaaaagcaacaa

SEQ ID NO: 1454 - RNA, 22 nt, Artificial Sequence
  Synthetic construct: hsa-miR-4424
agaguuaacucaaaauggacua

SEQ ID NO: 1455 - RNA, 22 nt, Artificial Sequence
  Synthetic construct: hsa-miR-4424
guccauuuugaguuaacucuuu

SEQ ID NO: 1456 - RNA, 22 nt, Artificial Sequence
  Synthetic construct: hsa-miR-4425
uguugggauucagcaggaccau

SEQ ID NO: 1457 - RNA, 22 nt, Artificial Sequence
  Synthetic construct: hsa-miR-4425
gguccugcugaaucccaacauu

SEQ ID NO: 1458 - RNA, 17 nt, Artificial Sequence
  Synthetic construct: hsa-miR-4426
gaagauggacguacuuu

SEQ ID NO: 1459 - RNA, 17 nt, Artificial Sequence
  Synthetic construct: hsa-miR-4426
aguacguccaucuucuu

SEQ ID NO: 1460 - RNA, 21 nt, Artificial Sequence
  Synthetic construct: hsa-miR-4427
ucugaauagagucugaagagu

SEQ ID NO: 1461 - RNA, 21 nt, Artificial Sequence
  Synthetic construct: hsa-miR-4427
ucuucagacucuauucagauu

SEQ ID NO: 1462 - RNA, 22 nt, Artificial Sequence
  Synthetic construct: hsa-miR-4428
caaggagacgggaacauggagc

SEQ ID NO: 1463 - RNA, 22 nt, Artificial Sequence
  Synthetic construct: hsa-miR-4428
uccauguucccgucuccuuguu

SEQ ID NO: 1464 - RNA, 20 nt, Artificial Sequence
  Synthetic construct: hsa-miR-4429
aaaagcugggcugagaggcg

SEQ ID NO: 1465 - RNA, 20 nt, Artificial Sequence
  Synthetic construct: hsa-miR-4429
ccucucagcccagcuuuuuu

SEQ ID NO: 1466 - RNA, 18 nt, Artificial Sequence
  Synthetic construct: hsa-miR-4430
aggcuggagugagcggag

SEQ ID NO: 1467 - RNA, 18 nt, Artificial Sequence
  Synthetic construct: hsa-miR-4430
ccgcucacuccagccuuu

SEQ ID NO: 1468 - RNA, 22 nt, Artificial Sequence
  Synthetic construct: hsa-miR-4431
gcgacucugaaaacuagaaggu

SEQ ID NO: 1469 - RNA, 22 nt, Artificial Sequence
  Synthetic construct: hsa-miR-4431
cuucuaguuuucagagucgcuu

SEQ ID NO: 1470 - RNA, 20 nt, Artificial Sequence
  Synthetic construct: hsa-miR-4432
aaagacucugcaagaugccu

SEQ ID NO: 1471 - RNA, 20 nt, Artificial Sequence
  Synthetic construct: hsa-miR-4432
gcaucuugcagagucuuuuu

SEQ ID NO: 1472 - RNA, 21 nt, Artificial Sequence
  Synthetic construct: hsa-miR-4433a
acaggagugggggugggacau

SEQ ID NO: 1473 - RNA, 21 nt, Artificial Sequence
  Synthetic construct: hsa-miR-4433a
cgucccaccccccacuccugu

SEQ ID NO: 1474 - RNA, 21 nt, Artificial Sequence
  Synthetic construct: hsa-miR-4433b
caggaguggggggugggacgu

SEQ ID NO: 1475 - RNA, 21 nt, Artificial Sequence
  Synthetic construct: hsa-miR-4433b
augucccacccccacuccugu

SEQ ID NO: 1476 - RNA, 18 nt, Artificial Sequence
  Synthetic construct: hsa-miR-4434
aggagaaguaaaguagaa

SEQ ID NO: 1477 - RNA, 18 nt, Artificial Sequence
  Synthetic construct: hsa-miR-4434
cuacuuuacuucuccuuu

SEQ ID NO: 1478 - RNA, 22 nt, Artificial Sequence
  Synthetic construct: hsa-miR-4435
auggccagagcucacacagagg

SEQ ID NO: 1479 - RNA, 22 nt, Artificial Sequence
  Synthetic construct: hsa-miR-4435
ucugugugagcucuggccauuu

SEQ ID NO: 1480 - RNA, 21 nt, Artificial Sequence
  Synthetic construct: hsa-miR-4436a
gcaggacaggcagaaguggau

SEQ ID NO: 1481 - RNA, 21 nt, Artificial Sequence
  Synthetic construct: hsa-miR-4436a
ccacuucugccuguccugcuu

SEQ ID NO: 1482 - RNA, 22 nt, Artificial Sequence
  Synthetic construct: hsa-miR-4436b
guccacuucugccugcccugcc

SEQ ID NO: 1483 - RNA, 22 nt, Artificial Sequence
  Synthetic construct: hsa-miR-4436b
cagggcaggaagaaguggacaa

SEQ ID NO: 1484 - RNA, 21 nt, Artificial Sequence
  Synthetic construct: hsa-miR-4437
ugggcucaggguacaaagguu

SEQ ID NO: 1485 - RNA, 21 nt, Artificial Sequence
  Synthetic construct: hsa-miR-4437
ccuuuguacccugagcccauu

SEQ ID NO: 1486 - RNA, 21 nt, Artificial Sequence
  Synthetic construct: hsa-miR-4438
cacaggcuuagaaaagacagu

SEQ ID NO: 1487 - RNA, 21 nt, Artificial Sequence
  Synthetic construct: hsa-miR-4438
ugucuuuucuaagccuguguu

SEQ ID NO: 1488 - RNA, 22 nt, Artificial Sequence
  Synthetic construct: hsa-miR-4439
gugacugauaccuuggaggcau

SEQ ID NO: 1489 - RNA, 22 nt, Artificial Sequence
  Synthetic construct: hsa-miR-4439
gccuccaagguaucagucacuu

SEQ ID NO: 1490 - RNA, 22 nt, Artificial Sequence
  Synthetic construct: hsa-miR-4440
ugucguggggcuugcuggcuug

SEQ ID NO: 1491 - RNA, 22 nt, Artificial Sequence
  Synthetic construct: hsa-miR-4440
agccagcaagccccacgacauu

SEQ ID NO: 1492 - RNA, 17 nt, Artificial Sequence
  Synthetic construct: hsa-miR-4441
acagggaggagauugua

SEQ ID NO: 1493 - RNA, 17 nt, Artificial Sequence
  Synthetic construct: hsa-miR-4441
caaucuccucccuguuu

SEQ ID NO: 1494 - RNA, 17 nt, Artificial Sequence
  Synthetic construct: hsa-miR-4442
gccggacaagagggagg

SEQ ID NO: 1495 - RNA, 17 nt, Artificial Sequence
  Synthetic construct: hsa-miR-4442
ucccucuuguccggcuu

SEQ ID NO: 1496 - RNA, 17 nt, Artificial Sequence
  Synthetic construct: hsa-miR-4443
uuggaggcguggguuuu

SEQ ID NO: 1497 - RNA, 17 nt, Artificial Sequence
  Synthetic construct: hsa-miR-4443
aacccacgccuccaauu

SEQ ID NO: 1498 - RNA, 18 nt, Artificial Sequence
  Synthetic construct: hsa-miR-4444
cucgaguuggaagaggcg

SEQ ID NO: 1499 - RNA, 18 nt, Artificial Sequence
  Synthetic construct: hsa-miR-4444
ccucuuccaacucgaguu

SEQ ID NO: 1500 - RNA, 22 nt, Artificial Sequence
  Synthetic construct: hsa-miR-4445
agauuguuucuuuugccgugca

SEQ ID NO: 1501 - RNA, 21 nt, Artificial Sequence
  Synthetic construct: hsa-miR-4445
cacggcaaaagaaacaaucca

SEQ ID NO: 1502 - RNA, 22 nt, Artificial Sequence
  Synthetic construct: hsa-miR-4446
auuucccugccauucccuuggc

SEQ ID NO: 1503 - RNA, 22 nt, Artificial Sequence
  Synthetic construct: hsa-miR-4446
cagggcuggcagugacaugggu

SEQ ID NO: 1504 - RNA, 17 nt, Artificial Sequence
  Synthetic construct: hsa-miR-4447
ggugggggcuguuguuu

SEQ ID NO: 1505 - RNA, 17 nt, Artificial Sequence
  Synthetic construct: hsa-miR-4447
acaacagcccccaccuu

SEQ ID NO: 1506 - RNA, 20 nt, Artificial Sequence
  Synthetic construct: hsa-miR-4448
ggcuccuuggucuaggggua

SEQ ID NO: 1507 - RNA, 20 nt, Artificial Sequence
  Synthetic construct: hsa-miR-4448
ccccuagaccaaggagccuu

SEQ ID NO: 1508 - RNA, 22 nt, Artificial Sequence
  Synthetic construct: hsa-miR-4449
cgucccggggcugcgcgaggca

SEQ ID NO: 1509 - RNA, 22 nt, Artificial Sequence
  Synthetic construct: hsa-miR-4449
ccucgcgcagccccgggacguu

SEQ ID NO: 1510 - RNA, 22 nt, Artificial Sequence
  Synthetic construct: hsa-miR-4450
uggggauuuggagaagugguga

SEQ ID NO: 1511 - RNA, 22 nt, Artificial Sequence
  Synthetic construct: hsa-miR-4450
accacuucuccaaauccccauu

SEQ ID NO: 1512 - RNA, 17 nt, Artificial Sequence
  Synthetic construct: hsa-miR-4451
ugguagagcugaggaca

SEQ ID NO: 1513 - RNA, 17 nt, Artificial Sequence
  Synthetic construct: hsa-miR-4451
uccucagcucuaccauu

SEQ ID NO: 1514 - RNA, 23 nt, Artificial Sequence
  Synthetic construct: hsa-miR-4452
uugaauucuuggccuuaagugau

SEQ ID NO: 1515 - RNA, 23 nt, Artificial Sequence
  Synthetic construct: hsa-miR-4452
cacuuaaggccaagaauucaauu

SEQ ID NO: 1516 - RNA, 20 nt, Artificial Sequence
  Synthetic construct: hsa-miR-4453
gagcuuggucuguagcgguu

SEQ ID NO: 1517 - RNA, 20 nt, Artificial Sequence
  Synthetic construct: hsa-miR-4453
ccgcuacagaccaagcucuu

SEQ ID NO: 1518 - RNA, 20 nt, Artificial Sequence
  Synthetic construct: hsa-miR-4454
ggauccgagucacggcacca

SEQ ID NO: 1519 - RNA, 20 nt, Artificial Sequence
  Synthetic construct: hsa-miR-4454
gugccgugacucggauccuu

SEQ ID NO: 1520 - RNA, 17 nt, Artificial Sequence
  Synthetic construct: hsa-miR-4455
aggguguguguguuuuu

SEQ ID NO: 1521 - RNA, 17 nt, Artificial Sequence
  Synthetic construct: hsa-miR-4455
aaacacacacacccuuu

SEQ ID NO: 1522 - RNA, 17 nt, Artificial Sequence
  Synthetic construct: hsa-miR-4456
ccugguggcuuccuuuu

SEQ ID NO: 1523 - RNA, 17 nt, Artificial Sequence
  Synthetic construct: hsa-miR-4456
aaggaagccaccagguu

SEQ ID NO: 1524 - RNA, 22 nt, Artificial Sequence
  Synthetic construct: hsa-miR-4457
ucacaagguauugacuggcgua

SEQ ID NO: 1525 - RNA, 22 nt, Artificial Sequence
  Synthetic construct: hsa-miR-4457
cgccagucaauaccuugugauu

SEQ ID NO: 1526 - RNA, 19 nt, Artificial Sequence
  Synthetic construct: hsa-miR-4458
agagguagguguggaagaa

SEQ ID NO: 1527 - RNA, 19 nt, Artificial Sequence
  Synthetic construct: hsa-miR-4458
cuuccacaccuaccucuuu

SEQ ID NO: 1528 - RNA, 22 nt, Artificial Sequence
  Synthetic construct: hsa-miR-4459
ccaggaggcggaggagguggag

SEQ ID NO: 1529 - RNA, 22 nt, Artificial Sequence
  Synthetic construct: hsa-miR-4459
ccaccuccuccgccuccugguu

SEQ ID NO: 1530 - RNA, 22 nt, Artificial Sequence
  Synthetic construct: hsa-miR-4460
auagugguugugaauuuaccuu

SEQ ID NO: 1531 - RNA, 22 nt, Artificial Sequence
  Synthetic construct: hsa-miR-4460
gguaaauucacaaccacuauuu

SEQ ID NO: 1532 - RNA, 23 nt, Artificial Sequence
  Synthetic construct: hsa-miR-4461
gauugagacuaguagggcuaggc

SEQ ID NO: 1533 - RNA, 23 nt, Artificial Sequence
  Synthetic construct: hsa-miR-4461
cuagcccuacuagucucaaucuu

SEQ ID NO: 1534 - RNA, 23 nt, Artificial Sequence
  Synthetic construct: hsa-miR-4462
ugacacggaggguggcuugggaa

SEQ ID NO: 1535 - RNA, 23 nt, Artificial Sequence
  Synthetic construct: hsa-miR-4462
cccaagccacccuccgugucauu

SEQ ID NO: 1536 - RNA, 17 nt, Artificial Sequence
  Synthetic construct: hsa-miR-4463
gagacugggguggggcc

SEQ ID NO: 1537 - RNA, 17 nt, Artificial Sequence
  Synthetic construct: hsa-miR-4463
ccccaccccagucucuu

SEQ ID NO: 1538 - RNA, 21 nt, Artificial Sequence
  Synthetic construct: hsa-miR-4464
aagguuuggauagaugcaaua

SEQ ID NO: 1539 - RNA, 21 nt, Artificial Sequence
  Synthetic construct: hsa-miR-4464
uugcaucuauccaaaccuuuu

SEQ ID NO: 1540 - RNA, 22 nt, Artificial Sequence
  Synthetic construct: hsa-miR-4465
cucaaguagucugaccagggga

SEQ ID NO: 1541 - RNA, 22 nt, Artificial Sequence
  Synthetic construct: hsa-miR-4465
cccuggucagacuacuugaguu

SEQ ID NO: 1542 - RNA, 18 nt, Artificial Sequence
  Synthetic construct: hsa-miR-4466
gggugcgggccggcgggg

SEQ ID NO: 1543 - RNA, 18 nt, Artificial Sequence
  Synthetic construct: hsa-miR-4466
ccgccggcccgcacccuu

SEQ ID NO: 1544 - RNA, 22 nt, Artificial Sequence
  Synthetic construct: hsa-miR-4467
uggcggcgguaguuaugggcuu

SEQ ID NO: 1545 - RNA, 22 nt, Artificial Sequence
  Synthetic construct: hsa-miR-4467
gcccauaacuaccgccgccauu

SEQ ID NO: 1546 - RNA, 18 nt, Artificial Sequence
  Synthetic construct: hsa-miR-4468
agagcagaaggaugagau

SEQ ID NO: 1547 - RNA, 18 nt, Artificial Sequence
  Synthetic construct: hsa-miR-4468
cucauccuucugcucuuu

SEQ ID NO: 1548 - RNA, 22 nt, Artificial Sequence
  Synthetic construct: hsa-miR-4469
gcucccucuagggucgcucgga

SEQ ID NO: 1549 - RNA, 22 nt, Artificial Sequence
  Synthetic construct: hsa-miR-4469
cgagcgacccuagagggagcuu

SEQ ID NO: 1550 - RNA, 21 nt, Artificial Sequence
  Synthetic construct: hsa-miR-4470
uggcaaacguggaagccgaga

SEQ ID NO: 1551 - RNA, 21 nt, Artificial Sequence
  Synthetic construct: hsa-miR-4470
ucggcuuccacguuugccauu

SEQ ID NO: 1552 - RNA, 22 nt, Artificial Sequence
  Synthetic construct: hsa-miR-4471
ugggaacuuaguagagguuuaa

SEQ ID NO: 1553 - RNA, 22 nt, Artificial Sequence
  Synthetic construct: hsa-miR-4471
aaaccucuacuaaguucccauu

SEQ ID NO: 1554 - RNA, 18 nt, Artificial Sequence
  Synthetic construct: hsa-miR-4472
ggugggggguguuguuuu

SEQ ID NO: 1555 - RNA, 18 nt, Artificial Sequence
  Synthetic construct: hsa-miR-4472
aacaacaccccccaccuu

SEQ ID NO: 1556 - RNA, 22 nt, Artificial Sequence
  Synthetic construct: hsa-miR-4473
cuagugcucuccguuacaagua

SEQ ID NO: 1557 - RNA, 22 nt, Artificial Sequence
  Synthetic construct: hsa-miR-4473
cuuguaacggagagcacuaguu

SEQ ID NO: 1558 - RNA, 22 nt, Artificial Sequence
  Synthetic construct: hsa-miR-4474
uuguggcuggucaugaggcuaa

SEQ ID NO: 1559 - RNA, 21 nt, Artificial Sequence
  Synthetic construct: hsa-miR-4474
uuagucucaugaucagacaca

SEQ ID NO: 1560 - RNA, 22 nt, Artificial Sequence
  Synthetic construct: hsa-miR-4475
caagggaccaagcauucauuau

SEQ ID NO: 1561 - RNA, 22 nt, Artificial Sequence
  Synthetic construct: hsa-miR-4475
aaugaaugcuuggucccuuguu

SEQ ID NO: 1562 - RNA, 22 nt, Artificial Sequence
  Synthetic construct: hsa-miR-4476
caggaaggauuuagggacaggc

SEQ ID NO: 1563 - RNA, 22 nt, Artificial Sequence
  Synthetic construct: hsa-miR-4476
cugucccuaaauccuuccuguu

SEQ ID NO: 1564 - RNA, 22 nt, Artificial Sequence
  Synthetic construct: hsa-miR-4477a
cuauuaaggacauuugugauuc

SEQ ID NO: 1565 - RNA, 22 nt, Artificial Sequence
  Synthetic construct: hsa-miR-4477a
aucacaaauguccuuaauaguu

SEQ ID NO: 1566 - RNA, 22 nt, Artificial Sequence
  Synthetic construct: hsa-miR-4477b
auuaaggacauuugugauugau

SEQ ID NO: 1567 - RNA, 22 nt, Artificial Sequence
  Synthetic construct: hsa-miR-4477b
caaucacaaauguccuuaauuu

SEQ ID NO: 1568 - RNA, 17 nt, Artificial Sequence
  Synthetic construct: hsa-miR-4478
gaggcugagcugaggag

SEQ ID NO: 1569 - RNA, 17 nt, Artificial Sequence
  Synthetic construct: hsa-miR-4478
ccucagcucagccucuu

SEQ ID NO: 1570 - RNA, 22 nt, Artificial Sequence
  Synthetic construct: hsa-miR-4479
cgcgcggccgugcucggagcag

SEQ ID NO: 1571 - RNA, 22 nt, Artificial Sequence
  Synthetic construct: hsa-miR-4479
gcuccgagcacggccgcgcguu

SEQ ID NO: 1572 - RNA, 22 nt, Artificial Sequence
  Synthetic construct: hsa-miR-448
uugcauauguaggaugucccau

SEQ ID NO: 1573 - RNA, 22 nt, Artificial Sequence
  Synthetic construct: hsa-miR-448
gggacauccuacauaugcaauu

SEQ ID NO: 1574 - RNA, 21 nt, Artificial Sequence
  Synthetic construct: hsa-miR-4480
agccaaguggaaguuacuuua

SEQ ID NO: 1575 - RNA, 21 nt, Artificial Sequence
  Synthetic construct: hsa-miR-4480
aaguaacuuccacuuggcuuu

SEQ ID NO: 1576 - RNA, 17 nt, Artificial Sequence
  Synthetic construct: hsa-miR-4481
ggagugggcuggugguu

SEQ ID NO: 1577 - RNA, 17 nt, Artificial Sequence
  Synthetic construct: hsa-miR-4481
ccaccagcccacuccuu

SEQ ID NO: 1578 - RNA, 22 nt, Artificial Sequence
  Synthetic construct: hsa-miR-4482
uuucuauuucucaguggggcuc

SEQ ID NO: 1579 - RNA, 22 nt, Artificial Sequence
  Synthetic construct: hsa-miR-4482
aacccagugggcuauggaaaug

SEQ ID NO: 1580 - RNA, 17 nt, Artificial Sequence
  Synthetic construct: hsa-miR-4483
gggguggucuguuguug

SEQ ID NO: 1581 - RNA, 17 nt, Artificial Sequence
  Synthetic construct: hsa-miR-4483
acaacagaccaccccuu

SEQ ID NO: 1582 - RNA, 20 nt, Artificial Sequence
  Synthetic construct: hsa-miR-4484
aaaaggcgggagaagcccca

SEQ ID NO: 1583 - RNA, 20 nt, Artificial Sequence
  Synthetic construct: hsa-miR-4484
gggcuucucccgccuuuuuu

SEQ ID NO: 1584 - RNA, 20 nt, Artificial Sequence
  Synthetic construct: hsa-miR-4485
uaacggccgcgguacccuaa

SEQ ID NO: 1585 - RNA, 16 nt, Artificial Sequence
  Synthetic construct: hsa-miR-4485
accgccugcccaguga

SEQ ID NO: 1586 - RNA, 17 nt, Artificial Sequence
  Synthetic construct: hsa-miR-4486
gcugggcgaggcuggca

SEQ ID NO: 1587 - RNA, 17 nt, Artificial Sequence
  Synthetic construct: hsa-miR-4486
ccagccucgcccagcuu

SEQ ID NO: 1588 - RNA, 19 nt, Artificial Sequence
  Synthetic construct: hsa-miR-4487
agagcuggcugaagggcag

SEQ ID NO: 1589 - RNA, 19 nt, Artificial Sequence
  Synthetic construct: hsa-miR-4487
gcccuucagccagcucuuu

SEQ ID NO: 1590 - RNA, 18 nt, Artificial Sequence
  Synthetic construct: hsa-miR-4488
agggggcgggcuccggcg

SEQ ID NO: 1591 - RNA, 18 nt, Artificial Sequence
  Synthetic construct: hsa-miR-4488
ccggagcccgcccccuuu

SEQ ID NO: 1592 - RNA, 21 nt, Artificial Sequence
  Synthetic construct: hsa-miR-4489
uggggcuagugaugcaggacg

SEQ ID NO: 1593 - RNA, 21 nt, Artificial Sequence
  Synthetic construct: hsa-miR-4489
uccugcaucacuagccccauu

SEQ ID NO: 1594 - RNA, 22 nt, Artificial Sequence
  Synthetic construct: hsa-miR-4490
ucugguaagagauuugggcaua

SEQ ID NO: 1595 - RNA, 22 nt, Artificial Sequence
  Synthetic construct: hsa-miR-4490
ugcccaaaucucuuaccagauu

SEQ ID NO: 1596 - RNA, 22 nt, Artificial Sequence
  Synthetic construct: hsa-miR-4491
aauguggacuggugugaccaaa

SEQ ID NO: 1597 - RNA, 22 nt, Artificial Sequence
  Synthetic construct: hsa-miR-4491
uggucacaccaguccacauuuu

SEQ ID NO: 1598 - RNA, 17 nt, Artificial Sequence
  Synthetic construct: hsa-miR-4492
ggggcugggcgcgcgcc

SEQ ID NO: 1599 - RNA, 17 nt, Artificial Sequence
  Synthetic construct: hsa-miR-4492
cgcgcgcccagccccuu

SEQ ID NO: 1600 - RNA, 21 nt, Artificial Sequence
  Synthetic construct: hsa-miR-4493
agaaggccuuuccaucucugu

SEQ ID NO: 1601 - RNA, 21 nt, Artificial Sequence
  Synthetic construct: hsa-miR-4493
agagauggaaaggccuucuuu

SEQ ID NO: 1602 - RNA, 22 nt, Artificial Sequence
  Synthetic construct: hsa-miR-4494
ccagacuguggcugaccagagg

SEQ ID NO: 1603 - RNA, 22 nt, Artificial Sequence
  Synthetic construct: hsa-miR-4494
ucuggucagccacagucugguu

SEQ ID NO: 1604 - RNA, 21 nt, Artificial Sequence
  Synthetic construct: hsa-miR-4495
aauguaaacaggcuuuuugcu

SEQ ID NO: 1605 - RNA, 21 nt, Artificial Sequence
  Synthetic construct: hsa-miR-4495
caaaaagccuguuuacauuuu

SEQ ID NO: 1606 - RNA, 22 nt, Artificial Sequence
  Synthetic construct: hsa-miR-4496
gaggaaacugaagcugagaggg

SEQ ID NO: 1607 - RNA, 22 nt, Artificial Sequence
  Synthetic construct: hsa-miR-4496
cucucagcuucaguuuccucuu

SEQ ID NO: 1608 - RNA, 17 nt, Artificial Sequence
  Synthetic construct: hsa-miR-4497
cuccgggacggcugggc

SEQ ID NO: 1609 - RNA, 17 nt, Artificial Sequence
  Synthetic construct: hsa-miR-4497
ccagccgucccggaguu

SEQ ID NO: 1610 - RNA, 22 nt, Artificial Sequence
  Synthetic construct: hsa-miR-4498
ugggcuggcagggcaagugcug

SEQ ID NO: 1611 - RNA, 22 nt, Artificial Sequence
  Synthetic construct: hsa-miR-4498
gcacuugcccugccagcccauu

SEQ ID NO: 1612 - RNA, 17 nt, Artificial Sequence
  Synthetic construct: hsa-miR-4499
aagacugagaggaggga

SEQ ID NO: 1613 - RNA, 17 nt, Artificial Sequence
  Synthetic construct: hsa-miR-4499
ccuccucucagucuuuu

SEQ ID NO: 1614 - RNA, 22 nt, Artificial Sequence
  Synthetic construct: hsa-miR-449a
uggcaguguauuguuagcuggu

SEQ ID NO: 1615 - RNA, 22 nt, Artificial Sequence
  Synthetic construct: hsa-miR-449a
cagcuaacaauacacugccauu

SEQ ID NO: 1616 - RNA, 22 nt, Artificial Sequence
  Synthetic construct: hsa-miR-449b
cagccacaacuacccugccacu

SEQ ID NO: 1617 - RNA, 22 nt, Artificial Sequence
  Synthetic construct: hsa-miR-449b
aggcaguguauuguuagcuggc

SEQ ID NO: 1618 - RNA, 25 nt, Artificial Sequence
  Synthetic construct: hsa-miR-449c
uaggcaguguauugcuagcggcugu

SEQ ID NO: 1619 - RNA, 23 nt, Artificial Sequence
  Synthetic construct: hsa-miR-449c
uugcuaguugcacuccucucugu

SEQ ID NO: 1620 - RNA, 17 nt, Artificial Sequence
  Synthetic construct: hsa-miR-4500
ugagguaguaguuucuu

SEQ ID NO: 1621 - RNA, 17 nt, Artificial Sequence
  Synthetic construct: hsa-miR-4500
gaaacuacuaccucauu

SEQ ID NO: 1622 - RNA, 21 nt, Artificial Sequence
  Synthetic construct: hsa-miR-4501
uaugugaccucggaugaauca

SEQ ID NO: 1623 - RNA, 21 nt, Artificial Sequence
  Synthetic construct: hsa-miR-4501
auucauccgaggucacauauu

SEQ ID NO: 1624 - RNA, 22 nt, Artificial Sequence
  Synthetic construct: hsa-miR-4502
gcugaugaugauggugcugaag

SEQ ID NO: 1625 - RNA, 22 nt, Artificial Sequence
  Synthetic construct: hsa-miR-4502
ucagcaccaucaucaucagcuu

SEQ ID NO: 1626 - RNA, 22 nt, Artificial Sequence
  Synthetic construct: hsa-miR-4503
uuuaagcaggaaauagaauuua

SEQ ID NO: 1627 - RNA, 22 nt, Artificial Sequence
  Synthetic construct: hsa-miR-4503
aauucuauuuccugcuuaaauu

SEQ ID NO: 1628 - RNA, 22 nt, Artificial Sequence
  Synthetic construct: hsa-miR-4504
ugugacaauagagaugaacaug

SEQ ID NO: 1629 - RNA, 22 nt, Artificial Sequence
  Synthetic construct: hsa-miR-4504
uguucaucucuauugucacauu

SEQ ID NO: 1630 - RNA, 18 nt, Artificial Sequence
  Synthetic construct: hsa-miR-4505
aggcugggcugggacgga

SEQ ID NO: 1631 - RNA, 18 nt, Artificial Sequence
  Synthetic construct: hsa-miR-4505
cgucccagcccagccuuu

SEQ ID NO: 1632 - RNA, 20 nt, Artificial Sequence
  Synthetic construct: hsa-miR-4506
aaauggguggucugaggcaa

SEQ ID NO: 1633 - RNA, 20 nt, Artificial Sequence
  Synthetic construct: hsa-miR-4506
gccucagaccacccauuuuu

SEQ ID NO: 1634 - RNA, 20 nt, Artificial Sequence
  Synthetic construct: hsa-miR-4507
cuggguugggcugggcuggg

SEQ ID NO: 1635 - RNA, 20 nt, Artificial Sequence
  Synthetic construct: hsa-miR-4507
cagcccagcccaacccaguu

SEQ ID NO: 1636 - RNA, 17 nt, Artificial Sequence
  Synthetic construct: hsa-miR-4508
gcggggcugggcgcgcg

SEQ ID NO: 1637 - RNA, 17 nt, Artificial Sequence
  Synthetic construct: hsa-miR-4508
cgcgcccagccccgcuu

SEQ ID NO: 1638 - RNA, 22 nt, Artificial Sequence
  Synthetic construct: hsa-miR-4509
acuaaaggauauagaagguuuu

SEQ ID NO: 1639 - RNA, 22 nt, Artificial Sequence
  Synthetic construct: hsa-miR-4509
aaccuucuauauccuuuaguuu

SEQ ID NO: 1640 - RNA, 22 nt, Artificial Sequence
  Synthetic construct: hsa-miR-450a-1
uuuugcgauguguuccuaauau

SEQ ID NO: 1641 - RNA, 22 nt, Artificial Sequence
  Synthetic construct: hsa-miR-450a-1
auugggaacauuuugcauguau

SEQ ID NO: 1642 - RNA, 22 nt, Artificial Sequence
  Synthetic construct: hsa-miR-450a-2
uuuugcgauguguuccuaauau

SEQ ID NO: 1643 - RNA, 22 nt, Artificial Sequence
  Synthetic construct: hsa-miR-450a-2
auuggggacauuuugcauucau

SEQ ID NO: 1644 - RNA, 22 nt, Artificial Sequence
  Synthetic construct: hsa-miR-450b
uuuugcaauauguuccugaaua

SEQ ID NO: 1645 - RNA, 22 nt, Artificial Sequence
  Synthetic construct: hsa-miR-450b
uugggaucauuuugcauccaua

SEQ ID NO: 1646 - RNA, 22 nt, Artificial Sequence
  Synthetic construct: hsa-miR-4510
ugagggaguaggauguaugguu

SEQ ID NO: 1647 - RNA, 22 nt, Artificial Sequence
  Synthetic construct: hsa-miR-4510
ccauacauccuacucccucauu

SEQ ID NO: 1648 - RNA, 22 nt, Artificial Sequence
  Synthetic construct: hsa-miR-4511
gaagaacuguugcauuugcccu

SEQ ID NO: 1649 - RNA, 22 nt, Artificial Sequence
  Synthetic construct: hsa-miR-4511
ggcaaaugcaacaguucuucuu

SEQ ID NO: 1650 - RNA, 22 nt, Artificial Sequence
  Synthetic construct: hsa-miR-4512
cagggccucacuguaucgccca

SEQ ID NO: 1651 - RNA, 22 nt, Artificial Sequence
  Synthetic construct: hsa-miR-4512
ggcgauacagugaggcccuguu

SEQ ID NO: 1652 - RNA, 22 nt, Artificial Sequence
  Synthetic construct: hsa-miR-4513
agacugacggcuggaggcccau

SEQ ID NO: 1653 - RNA, 22 nt, Artificial Sequence
  Synthetic construct: hsa-miR-4513
gggccuccagccgucagucuuu

SEQ ID NO: 1654 - RNA, 18 nt, Artificial Sequence
  Synthetic construct: hsa-miR-4514
acaggcaggauuggggaa

SEQ ID NO: 1655 - RNA, 18 nt, Artificial Sequence
  Synthetic construct: hsa-miR-4514
ccccaauccugccuguuu

SEQ ID NO: 1656 - RNA, 22 nt, Artificial Sequence
  Synthetic construct: hsa-miR-4515
aggacuggacucccggcagccc

SEQ ID NO: 1657 - RNA, 22 nt, Artificial Sequence
  Synthetic construct: hsa-miR-4515
gcugccgggaguccaguccuuu

SEQ ID NO: 1658 - RNA, 17 nt, Artificial Sequence
  Synthetic construct: hsa-miR-4516
gggagaagggucggggc

SEQ ID NO: 1659 - RNA, 17 nt, Artificial Sequence
  Synthetic construct: hsa-miR-4516
cccgacccuucucccuu

SEQ ID NO: 1660 - RNA, 25 nt, Artificial Sequence
  Synthetic construct: hsa-miR-4517
aaauaugaugaaacucacagcugag

SEQ ID NO: 1661 - RNA, 25 nt, Artificial Sequence
  Synthetic construct: hsa-miR-4517
cagcugugaguuucaucauauuuuu

SEQ ID NO: 1662 - RNA, 26 nt, Artificial Sequence
  Synthetic construct: hsa-miR-4518
gcucagggaugauaacugugcugaga

SEQ ID NO: 1663 - RNA, 26 nt, Artificial Sequence
  Synthetic construct: hsa-miR-4518
ucagcacaguuaucaucccugagcuu

SEQ ID NO: 1664 - RNA, 18 nt, Artificial Sequence
  Synthetic construct: hsa-miR-4519
cagcagugcgcagggcug

SEQ ID NO: 1665 - RNA, 18 nt, Artificial Sequence
  Synthetic construct: hsa-miR-4519
gcccugcgcacugcuguu

SEQ ID NO: 1666 - RNA, 22 nt, Artificial Sequence
  Synthetic construct: hsa-miR-451a
aaaccguuaccauuacugaguu

SEQ ID NO: 1667 - RNA, 22 nt, Artificial Sequence
  Synthetic construct: hsa-miR-451a
cucaguaaugguaacgguuuuu

SEQ ID NO: 1668 - RNA, 22 nt, Artificial Sequence
  Synthetic construct: hsa-miR-451b
uagcaagagaaccauuaccauu

SEQ ID NO: 1669 - RNA, 22 nt, Artificial Sequence
  Synthetic construct: hsa-miR-451b
ugguaaugguucucuugcuauu

SEQ ID NO: 1670 - RNA, 22 nt, Artificial Sequence
  Synthetic construct: hsa-miR-452
aacuguuugcagaggaaacuga

SEQ ID NO: 1671 - RNA, 22 nt, Artificial Sequence
  Synthetic construct: hsa-miR-452
cucaucugcaaagaaguaagug

SEQ ID NO: 1672 - RNA, 20 nt, Artificial Sequence
  Synthetic construct: hsa-miR-4520-1
ccugcguguuuucuguccaa

SEQ ID NO: 1673 - RNA, 22 nt, Artificial Sequence
  Synthetic construct: hsa-miR-4520-1
uuggacagaaaacacgcaggaa

SEQ ID NO: 1674 - RNA, 20 nt, Artificial Sequence
  Synthetic construct: hsa-miR-4520-2
ccugcguguuuucuguccaa

SEQ ID NO: 1675 - RNA, 22 nt, Artificial Sequence
  Synthetic construct: hsa-miR-4520-2
uuuggacagaaaacacgcaggu

SEQ ID NO: 1676 - RNA, 22 nt, Artificial Sequence
  Synthetic construct: hsa-miR-4521
gcuaaggaaguccugugcucag

SEQ ID NO: 1677 - RNA, 22 nt, Artificial Sequence
  Synthetic construct: hsa-miR-4521
gagcacaggacuuccuuagcuu

SEQ ID NO: 1678 - RNA, 21 nt, Artificial Sequence
  Synthetic construct: hsa-miR-4522
ugacucugccuguaggccggu

SEQ ID NO: 1679 - RNA, 21 nt, Artificial Sequence
  Synthetic construct: hsa-miR-4522
cggccuacaggcagagucauu

SEQ ID NO: 1680 - RNA, 21 nt, Artificial Sequence
  Synthetic construct: hsa-miR-4523
gaccgagagggccucggcugu

SEQ ID NO: 1681 - RNA, 21 nt, Artificial Sequence
  Synthetic construct: hsa-miR-4523
agccgaggcccucucggucuu

SEQ ID NO: 1682 - RNA, 22 nt, Artificial Sequence
  Synthetic construct: hsa-miR-4524a
auagcagcaugaaccugucuca

SEQ ID NO: 1683 - RNA, 22 nt, Artificial Sequence
  Synthetic construct: hsa-miR-4524a
ugagacaggcuuaugcugcuau

SEQ ID NO: 1684 - RNA, 21 nt, Artificial Sequence
  Synthetic construct: hsa-miR-4524b
auagcagcauaagccugucuc

SEQ ID NO: 1685 - RNA, 20 nt, Artificial Sequence
  Synthetic construct: hsa-miR-4524b
gagacagguucaugcugcua

SEQ ID NO: 1686 - RNA, 21 nt, Artificial Sequence
  Synthetic construct: hsa-miR-4525
ggggggaugugcaugcugguu

SEQ ID NO: 1687 - RNA, 21 nt, Artificial Sequence
  Synthetic construct: hsa-miR-4525
ccagcaugcacauccccccuu

SEQ ID NO: 1688 - RNA, 22 nt, Artificial Sequence
  Synthetic construct: hsa-miR-4526
gcugacagcagggcuggccgcu

SEQ ID NO: 1689 - RNA, 22 nt, Artificial Sequence
  Synthetic construct: hsa-miR-4526
cggccagcccugcugucagcuu

SEQ ID NO: 1690 - RNA, 22 nt, Artificial Sequence
  Synthetic construct: hsa-miR-4527
uggucugcaaagagaugacugu

SEQ ID NO: 1691 - RNA, 22 nt, Artificial Sequence
  Synthetic construct: hsa-miR-4527
agucaucucuuugcagaccauu

SEQ ID NO: 1692 - RNA, 22 nt, Artificial Sequence
  Synthetic construct: hsa-miR-4528
ucauuauauguaugaucuggac

SEQ ID NO: 1693 - RNA, 22 nt, Artificial Sequence
  Synthetic construct: hsa-miR-4528
ccagaucauacauauaaugauu

SEQ ID NO: 1694 - RNA, 22 nt, Artificial Sequence
  Synthetic construct: hsa-miR-4529
aggccaucagcaguccaaugaa

SEQ ID NO: 1695 - RNA, 21 nt, Artificial Sequence
  Synthetic construct: hsa-miR-4529
auuggacugcugauggcccgu

SEQ ID NO: 1696 - RNA, 18 nt, Artificial Sequence
  Synthetic construct: hsa-miR-4530
cccagcaggacgggagcg

SEQ ID NO: 1697 - RNA, 18 nt, Artificial Sequence
  Synthetic construct: hsa-miR-4530
cucccguccugcuggguu

SEQ ID NO: 1698 - RNA, 17 nt, Artificial Sequence
  Synthetic construct: hsa-miR-4531
auggagaaggcuucuga

SEQ ID NO: 1699 - RNA, 17 nt, Artificial Sequence
  Synthetic construct: hsa-miR-4531
agaagccuucuccauuu

SEQ ID NO: 1700 - RNA, 17 nt, Artificial Sequence
  Synthetic construct: hsa-miR-4532
ccccggggagcccggcg

SEQ ID NO: 1701 - RNA, 17 nt, Artificial Sequence
  Synthetic construct: hsa-miR-4532
ccgggcuccccgggguu

SEQ ID NO: 1702 - RNA, 22 nt, Artificial Sequence
  Synthetic construct: hsa-miR-4533
uggaaggagguugccggacgcu

SEQ ID NO: 1703 - RNA, 22 nt, Artificial Sequence
  Synthetic construct: hsa-miR-4533
cguccggcaaccuccuuccauu

SEQ ID NO: 1704 - RNA, 17 nt, Artificial Sequence
  Synthetic construct: hsa-miR-4534
ggauggaggaggggucu

SEQ ID NO: 1705 - RNA, 17 nt, Artificial Sequence
  Synthetic construct: hsa-miR-4534
accccuccuccauccuu

SEQ ID NO: 1706 - RNA, 17 nt, Artificial Sequence
  Synthetic construct: hsa-miR-4535
guggaccuggcugggac

SEQ ID NO: 1707 - RNA, 17 nt, Artificial Sequence
  Synthetic construct: hsa-miR-4535
cccagccagguccacuu

SEQ ID NO: 1708 - RNA, 21 nt, Artificial Sequence
  Synthetic construct: hsa-miR-4536
ucgugcauauaucuaccacau

SEQ ID NO: 1709 - RNA, 21 nt, Artificial Sequence
  Synthetic construct: hsa-miR-4536
ugugguagauauaugcacgau

SEQ ID NO: 1710 - RNA, 22 nt, Artificial Sequence
  Synthetic construct: hsa-miR-4537
ugagccgagcugagcuuagcug

SEQ ID NO: 1711 - RNA, 22 nt, Artificial Sequence
  Synthetic construct: hsa-miR-4537
gcuaagcucagcucggcucauu

SEQ ID NO: 1712 - RNA, 22 nt, Artificial Sequence
  Synthetic construct: hsa-miR-4538
gagcuuggaugagcugggcuga

SEQ ID NO: 1713 - RNA, 22 nt, Artificial Sequence
  Synthetic construct: hsa-miR-4538
agcccagcucauccaagcucuu

SEQ ID NO: 1714 - RNA, 22 nt, Artificial Sequence
  Synthetic construct: hsa-miR-4539
gcugaacugggcugagcugggc

SEQ ID NO: 1715 - RNA, 22 nt, Artificial Sequence
  Synthetic construct: hsa-miR-4539
ccagcucagcccaguucagcuu

SEQ ID NO: 1716 - RNA, 22 nt, Artificial Sequence
  Synthetic construct: hsa-miR-454
acccuaucaauauugucucugc

SEQ ID NO: 1717 - RNA, 23 nt, Artificial Sequence
  Synthetic construct: hsa-miR-454
uagugcaauauugcuuauagggu

SEQ ID NO: 1718 - RNA, 21 nt, Artificial Sequence
  Synthetic construct: hsa-miR-4540
uuaguccugccuguagguuua

SEQ ID NO: 1719 - RNA, 21 nt, Artificial Sequence
  Synthetic construct: hsa-miR-4540
aaccuacaggcaggacuaauu

SEQ ID NO: 1720 - RNA, 21 nt, Artificial Sequence
  Synthetic construct: hsa-miR-455
gcaguccaugggcauauacac

SEQ ID NO: 1721 - RNA, 22 nt, Artificial Sequence
  Synthetic construct: hsa-miR-455
uaugugccuuuggacuacaucg

SEQ ID NO: 1722 - RNA, 22 nt, Artificial Sequence
  Synthetic construct: hsa-miR-4632
ugccgcccucucgcugcucuag

SEQ ID NO: 1723 - RNA, 23 nt, Artificial Sequence
  Synthetic construct: hsa-miR-4632
gagggcagcguggguguggcgga

SEQ ID NO: 1724 - RNA, 20 nt, Artificial Sequence
  Synthetic construct: hsa-miR-4633
auaugccuggcuagcuccuc

SEQ ID NO: 1725 - RNA, 22 nt, Artificial Sequence
  Synthetic construct: hsa-miR-4633
aggagcuagccaggcauaugca

SEQ ID NO: 1726 - RNA, 19 nt, Artificial Sequence
  Synthetic construct: hsa-miR-4634
cggcgcgaccggcccgggg

SEQ ID NO: 1727 - RNA, 19 nt, Artificial Sequence
  Synthetic construct: hsa-miR-4634
ccgggccggucgcgccguu

SEQ ID NO: 1728 - RNA, 21 nt, Artificial Sequence
  Synthetic construct: hsa-miR-4635
ucuugaagucagaacccgcaa

SEQ ID NO: 1729 - RNA, 21 nt, Artificial Sequence
  Synthetic construct: hsa-miR-4635
gcggguucugacuucaagauu

SEQ ID NO: 1730 - RNA, 22 nt, Artificial Sequence
  Synthetic construct: hsa-miR-4636
aacucguguucaaagccuuuag

SEQ ID NO: 1731 - RNA, 22 nt, Artificial Sequence
  Synthetic construct: hsa-miR-4636
aaaggcuuugaacacgaguuuu

SEQ ID NO: 1732 - RNA, 22 nt, Artificial Sequence
  Synthetic construct: hsa-miR-4637
uacuaacugcagauucaaguga

SEQ ID NO: 1733 - RNA, 22 nt, Artificial Sequence
  Synthetic construct: hsa-miR-4637
acuugaaucugcaguuaguauu

SEQ ID NO: 1734 - RNA, 23 nt, Artificial Sequence
  Synthetic construct: hsa-miR-4638
ccuggacaccgcucagccggccg

SEQ ID NO: 1735 - RNA, 21 nt, Artificial Sequence
  Synthetic construct: hsa-miR-4638
acucggcugcgguggacaagu

SEQ ID NO: 1736 - RNA, 20 nt, Artificial Sequence
  Synthetic construct: hsa-miR-4639
ucacucucaccuugcuuugc

SEQ ID NO: 1737 - RNA, 22 nt, Artificial Sequence
  Synthetic construct: hsa-miR-4639
uugcuaaguaggcugagauuga

SEQ ID NO: 1738 - RNA, 23 nt, Artificial Sequence
  Synthetic construct: hsa-miR-4640
ugggccagggagcagcugguggg

SEQ ID NO: 1739 - RNA, 22 nt, Artificial Sequence
  Synthetic construct: hsa-miR-4640
cacccccuguuuccuggcccac

SEQ ID NO: 1740 - RNA, 24 nt, Artificial Sequence
  Synthetic construct: hsa-miR-4641
ugcccaugccauacuuuugccuca

SEQ ID NO: 1741 - RNA, 24 nt, Artificial Sequence
  Synthetic construct: hsa-miR-4641
aggcaaaaguauggcaugggcauu

SEQ ID NO: 1742 - RNA, 22 nt, Artificial Sequence
  Synthetic construct: hsa-miR-4642
auggcaucguccccugguggcu

SEQ ID NO: 1743 - RNA, 22 nt, Artificial Sequence
  Synthetic construct: hsa-miR-4642
ccaccaggggacgaugccauuu

SEQ ID NO: 1744 - RNA, 22 nt, Artificial Sequence
  Synthetic construct: hsa-miR-4643
gacacaugaccauaaaugcuaa

SEQ ID NO: 1745 - RNA, 22 nt, Artificial Sequence
  Synthetic construct: hsa-miR-4643
agcauuuauggucaugugucuu

SEQ ID NO: 1746 - RNA, 23 nt, Artificial Sequence
  Synthetic construct: hsa-miR-4644
uggagagagaaaagagacagaag

SEQ ID NO: 1747 - RNA, 23 nt, Artificial Sequence
  Synthetic construct: hsa-miR-4644
ucugucucuuuucucucuccauu

SEQ ID NO: 1748 - RNA, 19 nt, Artificial Sequence
  Synthetic construct: hsa-miR-4645
accaggcaagaaauauugu

SEQ ID NO: 1749 - RNA, 22 nt, Artificial Sequence
  Synthetic construct: hsa-miR-4645
agacaguaguucuugccugguu

SEQ ID NO: 1750 - RNA, 21 nt, Artificial Sequence
  Synthetic construct: hsa-miR-4646
auugucccucucccuucccag

SEQ ID NO: 1751 - RNA, 22 nt, Artificial Sequence
  Synthetic construct: hsa-miR-4646
acugggaagaggagcugaggga

SEQ ID NO: 1752 - RNA, 23 nt, Artificial Sequence
  Synthetic construct: hsa-miR-4647
gaagauggugcugugcugaggaa

SEQ ID NO: 1753 - RNA, 23 nt, Artificial Sequence
  Synthetic construct: hsa-miR-4647
ccucagcacagcaccaucuucuu

SEQ ID NO: 1754 - RNA, 20 nt, Artificial Sequence
  Synthetic construct: hsa-miR-4648
ugugggacugcaaaugggag

SEQ ID NO: 1755 - RNA, 20 nt, Artificial Sequence
  Synthetic construct: hsa-miR-4648
cccauuugcagucccacauu

SEQ ID NO: 1756 - RNA, 24 nt, Artificial Sequence
  Synthetic construct: hsa-miR-4649
ugggcgaggggugggcucucagag

SEQ ID NO: 1757 - RNA, 21 nt, Artificial Sequence
  Synthetic construct: hsa-miR-4649
ucugaggccugccucucccca

SEQ ID NO: 1758 - RNA, 21 nt, Artificial Sequence
  Synthetic construct: hsa-miR-4650
agguagaaugaggccugacau

SEQ ID NO: 1759 - RNA, 19 nt, Artificial Sequence
  Synthetic construct: hsa-miR-4650
ucaggccucuuucuaccuu

SEQ ID NO: 1760 - RNA, 20 nt, Artificial Sequence
  Synthetic construct: hsa-miR-4651
cggggugggugaggucgggc

SEQ ID NO: 1761 - RNA, 20 nt, Artificial Sequence
  Synthetic construct: hsa-miR-4651
ccgaccucacccaccccguu

SEQ ID NO: 1762 - RNA, 22 nt, Artificial Sequence
  Synthetic construct: hsa-miR-4652
aggggacugguuaauagaacua

SEQ ID NO: 1763 - RNA, 22 nt, Artificial Sequence
  Synthetic construct: hsa-miR-4652
guucuguuaacccauccccuca

SEQ ID NO: 1764 - RNA, 22 nt, Artificial Sequence
  Synthetic construct: hsa-miR-4653
ucucugagcaaggcuuaacacc

SEQ ID NO: 1765 - RNA, 23 nt, Artificial Sequence
  Synthetic construct: hsa-miR-4653
uggaguuaaggguugcuuggaga

SEQ ID NO: 1766 - RNA, 22 nt, Artificial Sequence
  Synthetic construct: hsa-miR-4654
ugugggaucuggaggcaucugg

SEQ ID NO: 1767 - RNA, 22 nt, Artificial Sequence
  Synthetic construct: hsa-miR-4654
agaugccuccagaucccacauu

SEQ ID NO: 1768 - RNA, 21 nt, Artificial Sequence
  Synthetic construct: hsa-miR-4655
acccucgucagguccccgggg

SEQ ID NO: 1769 - RNA, 22 nt, Artificial Sequence
  Synthetic construct: hsa-miR-4655
caccggggauggcagagggucg

SEQ ID NO: 1770 - RNA, 23 nt, Artificial Sequence
  Synthetic construct: hsa-miR-4656
ugggcugagggcaggaggccugu

SEQ ID NO: 1771 - RNA, 23 nt, Artificial Sequence
  Synthetic construct: hsa-miR-4656
aggccuccugcccucagcccauu

SEQ ID NO: 1772 - RNA, 23 nt, Artificial Sequence
  Synthetic construct: hsa-miR-4657
aauguggaaguggucugaggcau

SEQ ID NO: 1773 - RNA, 23 nt, Artificial Sequence
  Synthetic construct: hsa-miR-4657
gccucagaccacuuccacauuuu

SEQ ID NO: 1774 - RNA, 23 nt, Artificial Sequence
  Synthetic construct: hsa-miR-4658
gugaguguggauccuggaggaau

SEQ ID NO: 1775 - RNA, 23 nt, Artificial Sequence
  Synthetic construct: hsa-miR-4658
uccuccaggauccacacucacuu

SEQ ID NO: 1776 - RNA, 22 nt, Artificial Sequence
  Synthetic construct: hsa-miR-4659a
uuucuucuuagacauggcaacg

SEQ ID NO: 1777 - RNA, 22 nt, Artificial Sequence
  Synthetic construct: hsa-miR-4659a
cugccaugucuaagaagaaaac

SEQ ID NO: 1778 - RNA, 22 nt, Artificial Sequence
  Synthetic construct: hsa-miR-4659b
uuucuucuuagacauggcagcu

SEQ ID NO: 1779 - RNA, 19 nt, Artificial Sequence
  Synthetic construct: hsa-miR-4659b
uugccaugucuaagaagaa

SEQ ID NO: 1780 - RNA, 23 nt, Artificial Sequence
  Synthetic construct: hsa-miR-466
auacacauacacgcaacacacau

SEQ ID NO: 1781 - RNA, 23 nt, Artificial Sequence
  Synthetic construct: hsa-miR-466
guguguugcguguauguguauuu

SEQ ID NO: 1782 - RNA, 23 nt, Artificial Sequence
  Synthetic construct: hsa-miR-4660
ugcagcucugguggaaaauggag

SEQ ID NO: 1783 - RNA, 23 nt, Artificial Sequence
  Synthetic construct: hsa-miR-4660
ccauuuuccaccagagcugcauu

SEQ ID NO: 1784 - RNA, 22 nt, Artificial Sequence
  Synthetic construct: hsa-miR-4661
aacuagcucuguggauccugac

SEQ ID NO: 1785 - RNA, 22 nt, Artificial Sequence
  Synthetic construct: hsa-miR-4661
caggauccacagagcuagucca

SEQ ID NO: 1786 - RNA, 22 nt, Artificial Sequence
  Synthetic construct: hsa-miR-4662a
uuagccaauuguccaucuuuag

SEQ ID NO: 1787 - RNA, 22 nt, Artificial Sequence
  Synthetic construct: hsa-miR-4662a
aaagauagacaauuggcuaaau

SEQ ID NO: 1788 - RNA, 22 nt, Artificial Sequence
  Synthetic construct: hsa-miR-4662b
aaagauggacaauuggcuaaau

SEQ ID NO: 1789 - RNA, 22 nt, Artificial Sequence
  Synthetic construct: hsa-miR-4662b
uuagccaauuguccaucuuuuu

SEQ ID NO: 1790 - RNA, 24 nt, Artificial Sequence
  Synthetic construct: hsa-miR-4663
agcugagcuccauggacgugcagu

SEQ ID NO: 1791 - RNA, 24 nt, Artificial Sequence
  Synthetic construct: hsa-miR-4663
ugcacguccauggagcucagcuuu

SEQ ID NO: 1792 - RNA, 22 nt, Artificial Sequence
  Synthetic construct: hsa-miR-4664
cuuccggucugugagccccguc

SEQ ID NO: 1793 - RNA, 22 nt, Artificial Sequence
  Synthetic construct: hsa-miR-4664
uggggugcccacuccgcaaguu

SEQ ID NO: 1794 - RNA, 26 nt, Artificial Sequence
  Synthetic construct: hsa-miR-4665
cucggccgcggcgcguagcccccgcc

SEQ ID NO: 1795 - RNA, 23 nt, Artificial Sequence
  Synthetic construct: hsa-miR-4665
cugggggacgcgugagcgcgagc

SEQ ID NO: 1796 - RNA, 21 nt, Artificial Sequence
  Synthetic construct: hsa-miR-4666a
auacaugucagauuguaugcc

SEQ ID NO: 1797 - RNA, 21 nt, Artificial Sequence
  Synthetic construct: hsa-miR-4666a
cauacaaucugacauguauuu

SEQ ID NO: 1798 - RNA, 23 nt, Artificial Sequence
  Synthetic construct: hsa-miR-4666b
uugcaugucagauuguaauuccc

SEQ ID NO: 1799 - RNA, 23 nt, Artificial Sequence
  Synthetic construct: hsa-miR-4666b
gaauuacaaucugacaugcaauu

SEQ ID NO: 1800 - RNA, 22 nt, Artificial Sequence
  Synthetic construct: hsa-miR-4667
acuggggagcagaaggagaacc

SEQ ID NO: 1801 - RNA, 21 nt, Artificial Sequence
  Synthetic construct: hsa-miR-4667
ucccuccuucuguccccacag

SEQ ID NO: 1802 - RNA, 23 nt, Artificial Sequence
  Synthetic construct: hsa-miR-4668
agggaaaaaaaaaaggauuuguc

SEQ ID NO: 1803 - RNA, 23 nt, Artificial Sequence
  Synthetic construct: hsa-miR-4668
gaaaauccuuuuuguuuuuccag

SEQ ID NO: 1804 - RNA, 22 nt, Artificial Sequence
  Synthetic construct: hsa-miR-4669
uguguccgggaaguggaggagg

SEQ ID NO: 1805 - RNA, 22 nt, Artificial Sequence
  Synthetic construct: hsa-miR-4669
uccuccacuucccggacacauu

SEQ ID NO: 1806 - RNA, 22 nt, Artificial Sequence
  Synthetic construct: hsa-miR-4670
aagcgaccaugauguaacuuca

SEQ ID NO: 1807 - RNA, 22 nt, Artificial Sequence
  Synthetic construct: hsa-miR-4670
ugaaguuacaucauggucgcuu

SEQ ID NO: 1808 - RNA, 22 nt, Artificial Sequence
  Synthetic construct: hsa-miR-4671
accgaagacugugcgcuaaucu

SEQ ID NO: 1809 - RNA, 21 nt, Artificial Sequence
  Synthetic construct:
uuagugcauagucuuuggucu

SEQ ID NO: 1810 - RNA, 21 nt, Artificial Sequence
  Synthetic construct: hsa-miR-4672
uuacacagcuggacagaggca

SEQ ID NO: 1811 - RNA, 21 nt, Artificial Sequence
  Synthetic construct: hsa-miR-4672
ccucuguccagcuguguaauu

SEQ ID NO: 1812 - RNA, 22 nt, Artificial Sequence
  Synthetic construct: hsa-miR-4673
uccaggcaggagccggacugga

SEQ ID NO: 1813 - RNA, 22 nt, Artificial Sequence
  Synthetic construct: hsa-miR-4673
caguccggcuccugccuggauu

SEQ ID NO: 1814 - RNA, 21 nt, Artificial Sequence
  Synthetic construct: hsa-miR-4674
cugggcucgggacgcgcggcu

SEQ ID NO: 1815 - RNA, 21 nt, Artificial Sequence
  Synthetic construct: hsa-miR-4674
ccgcgcgucccgagcccaguu

SEQ ID NO: 1816 - RNA, 22 nt, Artificial Sequence
  Synthetic construct: hsa-miR-4675
ggggcugugauugaccagcagg

SEQ ID NO: 1817 - RNA, 22 nt, Artificial Sequence
  Synthetic construct: hsa-miR-4675
ugcuggucaaucacagccccuu

SEQ ID NO: 1818 - RNA, 21 nt, Artificial Sequence
  Synthetic construct: hsa-miR-4676
gagccaguggugagacaguga

SEQ ID NO: 1819 - RNA, 22 nt, Artificial Sequence
  Synthetic construct: hsa-miR-4676
cacuguuucaccacuggcucuu

SEQ ID NO: 1820 - RNA, 22 nt, Artificial Sequence
  Synthetic construct: hsa-miR-4677
uuguucuuuggucuuucagcca

SEQ ID NO: 1821 - RNA, 22 nt, Artificial Sequence
  Synthetic construct: hsa-miR-4677
ucugugagaccaaagaacuacu

SEQ ID NO: 1822 - RNA, 22 nt, Artificial Sequence
  Synthetic construct: hsa-miR-4678
aagguauuguucagacuuauga

SEQ ID NO: 1823 - RNA, 22 nt, Artificial Sequence
  Synthetic construct: hsa-miR-4678
auaagucugaacaauaccuuuu

SEQ ID NO: 1824 - RNA, 22 nt, Artificial Sequence
  Synthetic construct: hsa-miR-4679
ucugugauagagauucuuugcu

SEQ ID NO: 1825 - RNA, 22 nt, Artificial Sequence
  Synthetic construct: hsa-miR-4679
caaagaaucucuaucacagauu

SEQ ID NO: 1826 - RNA, 21 nt, Artificial Sequence
  Synthetic construct: hsa-miR-4680
ucugaauuguaagaguuguua

SEQ ID NO: 1827 - RNA, 23 nt, Artificial Sequence
  Synthetic construct: hsa-miR-4680
agaacucuugcagucuuagaugu

SEQ ID NO: 1828 - RNA, 22 nt, Artificial Sequence
  Synthetic construct: hsa-miR-4681
aacgggaaugcaggcuguaucu

SEQ ID NO: 1829 - RNA, 22 nt, Artificial Sequence
  Synthetic construct: hsa-miR-4681
auacagccugcauucccguuuu

SEQ ID NO: 1830 - RNA, 23 nt, Artificial Sequence
  Synthetic construct: hsa-miR-4682
ucugaguuccuggagccuggucu

SEQ ID NO: 1831 - RNA, 23 nt, Artificial Sequence
  Synthetic construct: hsa-miR-4682
accaggcuccaggaacucagauu

SEQ ID NO: 1832 - RNA, 23 nt, Artificial Sequence
  Synthetic construct: hsa-miR-4683
uggagauccagugcucgcccgau

SEQ ID NO: 1833 - RNA, 23 nt, Artificial Sequence
  Synthetic construct: hsa-miR-4683
cgggcgagcacuggaucuccauu

SEQ ID NO: 1834 - RNA, 22 nt, Artificial Sequence
  Synthetic construct: hsa-miR-4684
cucucuacugacuugcaacaua

SEQ ID NO: 1835 - RNA, 22 nt, Artificial Sequence
  Synthetic construct: hsa-miR-4684
uguugcaagucgguggagacgu

SEQ ID NO: 1836 - RNA, 26 nt, Artificial Sequence
  Synthetic construct: hsa-miR-4685
cccagggcuuggaguggggcaagguu

SEQ ID NO: 1837 - RNA, 22 nt, Artificial Sequence
  Synthetic construct: hsa-miR-4685
ucucccuuccugcccuggcuag

SEQ ID NO: 1838 - RNA, 23 nt, Artificial Sequence
  Synthetic construct: hsa-miR-4686
uaucugcugggcuuucugguguu

SEQ ID NO: 1839 - RNA, 23 nt, Artificial Sequence
  Synthetic construct: hsa-miR-4686
caccagaaagcccagcagauauu

SEQ ID NO: 1840 - RNA, 21 nt, Artificial Sequence
  Synthetic construct: hsa-miR-4687
uggcuguuggagggggcaggc

SEQ ID NO: 1841 - RNA, 22 nt, Artificial Sequence
  Synthetic construct: hsa-miR-4687
cagcccuccucccgcacccaaa

SEQ ID NO: 1842 - RNA, 22 nt, Artificial Sequence
  Synthetic construct: hsa-miR-4688
uaggggcagcagaggaccuggg

SEQ ID NO: 1843 - RNA, 22 nt, Artificial Sequence
  Synthetic construct: hsa-miR-4688
cagguccucugcugccccuauu

SEQ ID NO: 1844 - RNA, 22 nt, Artificial Sequence
  Synthetic construct: hsa-miR-4689
uugaggagacauggugggggcc

SEQ ID NO: 1845 - RNA, 22 nt, Artificial Sequence
  Synthetic construct: hsa-miR-4689
cccccaccaugucuccucaauu

SEQ ID NO: 1846 - RNA, 21 nt, Artificial Sequence
  Synthetic construct: hsa-miR-4690
gcagcccagcugaggccucug

SEQ ID NO: 1847 - RNA, 22 nt, Artificial Sequence
  Synthetic construct: hsa-miR-4690
gagcaggcgaggcugggcugaa

SEQ ID NO: 1848 - RNA, 23 nt, Artificial Sequence
  Synthetic construct: hsa-miR-4691
guccuccaggccaugagcugcgg

SEQ ID NO: 1849 - RNA, 23 nt, Artificial Sequence
  Synthetic construct: hsa-miR-4691
ccagccacggacugagagugcau

SEQ ID NO: 1850 - RNA, 22 nt, Artificial Sequence
  Synthetic construct: hsa-miR-4692
ucaggcaguguggguaucagau

SEQ ID NO: 1851 - RNA, 22 nt, Artificial Sequence
  Synthetic construct: hsa-miR-4692
cugauacccacacugccugauu

SEQ ID NO: 1852 - RNA, 23 nt, Artificial Sequence
  Synthetic construct: hsa-miR-4693
auacugugaauuucacugucaca

SEQ ID NO: 1853 - RNA, 23 nt, Artificial Sequence
  Synthetic construct: hsa-miR-4693
ugagaguggaauucacaguauuu

SEQ ID NO: 1854 - RNA, 22 nt, Artificial Sequence
  Synthetic construct: hsa-miR-4694
agguguuauccuauccauuugc

SEQ ID NO: 1855 - RNA, 21 nt, Artificial Sequence
  Synthetic construct: hsa-miR-4694
caaauggacaggauaacaccu

SEQ ID NO: 1856 - RNA, 22 nt, Artificial Sequence
  Synthetic construct: hsa-miR-4695
caggaggcagugggcgagcagg

SEQ ID NO: 1857 - RNA, 22 nt, Artificial Sequence
  Synthetic construct: hsa-miR-4695
ugaucucaccgcugccuccuuc

SEQ ID NO: 1858 - RNA, 22 nt, Artificial Sequence
  Synthetic construct: hsa-miR-4696
ugcaagacggauacugucaucu

SEQ ID NO: 1859 - RNA, 22 nt, Artificial Sequence
  Synthetic construct: hsa-miR-4696
augacaguauccgucuugcauu

SEQ ID NO: 1860 - RNA, 22 nt, Artificial Sequence
  Synthetic construct: hsa-miR-4697
agggggcgcagucacugacgug

SEQ ID NO: 1861 - RNA, 24 nt, Artificial Sequence
  Synthetic construct: hsa-miR-4697
ugucagugacuccugccccuuggu

SEQ ID NO: 1862 - RNA, 23 nt, Artificial Sequence
  Synthetic construct: hsa-miR-4698
ucaaaauguagaggaagacccca

SEQ ID NO: 1863 - RNA, 23 nt, Artificial Sequence
  Synthetic construct: hsa-miR-4698
gggucuuccucuacauuuugauu

SEQ ID NO: 1864 - RNA, 22 nt, Artificial Sequence
  Synthetic construct: hsa-miR-4699
aauuuacucugcaaucuucucc

SEQ ID NO: 1865 - RNA, 22 nt, Artificial Sequence
  Synthetic construct: hsa-miR-4699
agaagauugcagaguaaguucc

SEQ ID NO: 1866 - RNA, 26 nt, Artificial Sequence
  Synthetic construct: hsa-miR-4700
cacaggacugacuccucaccccagug

SEQ ID NO: 1867 - RNA, 22 nt, Artificial Sequence
  Synthetic construct: hsa-miR-4700
ucuggggaugaggacagugugu

SEQ ID NO: 1868 - RNA, 22 nt, Artificial Sequence
  Synthetic construct: hsa-miR-4701
uuggccaccacaccuaccccuu

SEQ ID NO: 1869 - RNA, 20 nt, Artificial Sequence
  Synthetic construct: hsa-miR-4701
augggugauggguguggugu

SEQ ID NO: 1870 - RNA, 22 nt, Artificial Sequence
  Synthetic construct: hsa-miR-4703
uguaguuguauuguauugccac

SEQ ID NO: 1871 - RNA, 23 nt, Artificial Sequence
  Synthetic construct: hsa-miR-4703
uagcaauacaguacaaauauagu

SEQ ID NO: 1872 - RNA, 22 nt, Artificial Sequence
  Synthetic construct: hsa-miR-4704
ucagucacauaucuagugucua

SEQ ID NO: 1873 - RNA, 22 nt, Artificial Sequence
  Synthetic construct: hsa-miR-4704
gacacuaggcaugugagugauu

SEQ ID NO: 1874 - RNA, 22 nt, Artificial Sequence
  Synthetic construct: hsa-miR-4705
ucaaucacuugguaauugcugu

SEQ ID NO: 1875 - RNA, 22 nt, Artificial Sequence
  Synthetic construct: hsa-miR-4705
agcaauuaccaagugauugauu

SEQ ID NO: 1876 - RNA, 25 nt, Artificial Sequence
  Synthetic construct: hsa-miR-4706
agcggggaggaagugggcgcugcuu

SEQ ID NO: 1877 - RNA, 25 nt, Artificial Sequence
  Synthetic construct: hsa-miR-4706
gcagcgcccacuuccuccccgcuuu

SEQ ID NO: 1878 - RNA, 22 nt, Artificial Sequence
  Synthetic construct: hsa-miR-4707
agcccgccccagccgagguucu

SEQ ID NO: 1879 - RNA, 23 nt, Artificial Sequence
  Synthetic construct: hsa-miR-4707
gccccggcgcgggcggguucugg

SEQ ID NO: 1880 - RNA, 21 nt, Artificial Sequence
  Synthetic construct: hsa-miR-4708
agagaugccgccuugcuccuu

SEQ ID NO: 1881 - RNA, 22 nt, Artificial Sequence
  Synthetic construct: hsa-miR-4708
agcaaggcggcaucucucugau

SEQ ID NO: 1882 - RNA, 22 nt, Artificial Sequence
  Synthetic construct: hsa-miR-4709
acaacagugacuugcucuccaa

SEQ ID NO: 1883 - RNA, 23 nt, Artificial Sequence
  Synthetic construct: hsa-miR-4709
uugaagaggaggugcucuguagc

SEQ ID NO: 1884 - RNA, 18 nt, Artificial Sequence
  Synthetic construct: hsa-miR-4710
gggugagggcaggugguu

SEQ ID NO: 1885 - RNA, 18 nt, Artificial Sequence
  Synthetic construct: hsa-miR-4710
ccaccugcccucacccuu

SEQ ID NO: 1886 - RNA, 18 nt, Artificial Sequence
  Synthetic construct: hsa-miR-4711
cgugucuucuggcuugau

SEQ ID NO: 1887 - RNA, 23 nt, Artificial Sequence
  Synthetic construct: hsa-miR-4711
ugcaucaggccagaagacaugag

SEQ ID NO: 1888 - RNA, 21 nt, Artificial Sequence
  Synthetic construct: hsa-miR-4712
aaugagagaccuguacuguau

SEQ ID NO: 1889 - RNA, 22 nt, Artificial Sequence
  Synthetic construct: hsa-miR-4712
uccaguacaggucucucauuuc

SEQ ID NO: 1890 - RNA, 22 nt, Artificial Sequence
  Synthetic construct: hsa-miR-4713
uucucccacuaccaggcuccca

SEQ ID NO: 1891 - RNA, 22 nt, Artificial Sequence
  Synthetic construct: hsa-miR-4713
ugggauccagacagugggagaa

SEQ ID NO: 1892 - RNA, 22 nt, Artificial Sequence
  Synthetic construct: hsa-miR-4714
aacucugaccccuuagguugau

SEQ ID NO: 1893 - RNA, 22 nt, Artificial Sequence
  Synthetic construct: hsa-miR-4714
ccaaccuagguggucagaguug

SEQ ID NO: 1894 - RNA, 23 nt, Artificial Sequence
  Synthetic construct: hsa-miR-4715
gugccaccuuaacugcagccaau

SEQ ID NO: 1895 - RNA, 22 nt, Artificial Sequence
  Synthetic construct: hsa-miR-4715
aaguuggcugcaguuaaggugg

SEQ ID NO: 1896 - RNA, 22 nt, Artificial Sequence
  Synthetic construct: hsa-miR-4716
aagggggaaggaaacauggaga

SEQ ID NO: 1897 - RNA, 22 nt, Artificial Sequence
  Synthetic construct: hsa-miR-4716
uccauguuuccuucccccuucu

SEQ ID NO: 1898 - RNA, 21 nt, Artificial Sequence
  Synthetic construct: hsa-miR-4717
acacauggguggcuguggccu

SEQ ID NO: 1899 - RNA, 22 nt, Artificial Sequence
  Synthetic construct: hsa-miR-4717
uaggccacagccacccaugugu

SEQ ID NO: 1900 - RNA, 21 nt, Artificial Sequence
  Synthetic construct: hsa-miR-4718
agcuguaccugaaaccaagca

SEQ ID NO: 1901 - RNA, 21 nt, Artificial Sequence
  Synthetic construct: hsa-miR-4718
cuugguuucagguacagcuuu

SEQ ID NO: 1902 - RNA, 22 nt, Artificial Sequence
  Synthetic construct: hsa-miR-4719
ucacaaaucuauaauaugcagg

SEQ ID NO: 1903 - RNA, 22 nt, Artificial Sequence
  Synthetic construct: hsa-miR-4719
ugcauauuauagauuugugauu

SEQ ID NO: 1904 - RNA, 21 nt, Artificial Sequence
  Synthetic construct: hsa-miR-4720
ugcuuaaguuguaccaaguau

SEQ ID NO: 1905 - RNA, 22 nt, Artificial Sequence
  Synthetic construct: hsa-miR-4720
ccuggcauauuugguauaacuu

SEQ ID NO: 1906 - RNA, 22 nt, Artificial Sequence
  Synthetic construct: hsa-miR-4721
ugagggcuccaggugacggugg

SEQ ID NO: 1907 - RNA, 22 nt, Artificial Sequence
  Synthetic construct: hsa-miR-4721
accgucaccuggagcccucauu

SEQ ID NO: 1908 - RNA, 23 nt, Artificial Sequence
  Synthetic construct: hsa-miR-4722
ggcaggagggcugugccagguug

SEQ ID NO: 1909 - RNA, 22 nt, Artificial Sequence
  Synthetic construct: hsa-miR-4722
accugccagcaccucccugcag

SEQ ID NO: 1910 - RNA, 24 nt, Artificial Sequence
  Synthetic construct: hsa-miR-4723
ugggggagccaugagauaagagca

SEQ ID NO: 1911 - RNA, 22 nt, Artificial Sequence
  Synthetic construct: hsa-miR-4723
cccucucuggcuccuccccaaa

SEQ ID NO: 1912 - RNA, 23 nt, Artificial Sequence
  Synthetic construct: hsa-miR-4724
aacugaaccaggagugagcuucg

SEQ ID NO: 1913 - RNA, 21 nt, Artificial Sequence
  Synthetic construct: hsa-miR-4724
guaccuucugguucagcuagu

SEQ ID NO: 1914 - RNA, 21 nt, Artificial Sequence
  Synthetic construct: hsa-miR-4725
agacccugcagccuucccacc

SEQ ID NO: 1915 - RNA, 22 nt, Artificial Sequence
  Synthetic construct: hsa-miR-4725
uggggaaggcgucagugucggg

SEQ ID NO: 1916 - RNA, 22 nt, Artificial Sequence
  Synthetic construct: hsa-miR-4726
acccagguucccucuggccgca

SEQ ID NO: 1917 - RNA, 23 nt, Artificial Sequence
  Synthetic construct: hsa-miR-4726
agggccagaggagccuggagugg

SEQ ID NO: 1918 - RNA, 22 nt, Artificial Sequence
  Synthetic construct: hsa-miR-4727
auagugggaagcuggcagauuc

SEQ ID NO: 1919 - RNA, 21 nt, Artificial Sequence
  Synthetic construct: hsa-miR-4727
aucugccagcuuccacagugg

SEQ ID NO: 1920 - RNA, 25 nt, Artificial Sequence
  Synthetic construct: hsa-miR-4728
caugcugaccucccuccugccccag

SEQ ID NO: 1921 - RNA, 23 nt, Artificial Sequence
  Synthetic construct: hsa-miR-4728
ugggaggggagaggcagcaagca

SEQ ID NO: 1922 - RNA, 22 nt, Artificial Sequence
  Synthetic construct: hsa-miR-4729
ucauuuaucuguugggaagcua

SEQ ID NO: 1923 - RNA, 22 nt, Artificial Sequence
  Synthetic construct: hsa-miR-4729
gcuucccaacagauaaaugauu

SEQ ID NO: 1924 - RNA, 23 nt, Artificial Sequence
  Synthetic construct: hsa-miR-4730
cuggcggagcccauuccaugcca

SEQ ID NO: 1925 - RNA, 23 nt, Artificial Sequence
  Synthetic construct: hsa-miR-4730
gcauggaaugggcuccgccaguu

SEQ ID NO: 1926 - RNA, 22 nt, Artificial Sequence
  Synthetic construct: hsa-miR-4731
ugcugggggccacaugagugug

SEQ ID NO: 1927 - RNA, 22 nt, Artificial Sequence
  Synthetic construct: hsa-miR-4731
cacacaaguggcccccaacacu

SEQ ID NO: 1928 - RNA, 23 nt, Artificial Sequence
  Synthetic construct: hsa-miR-4732
uguagagcagggagcaggaagcu

SEQ ID NO: 1929 - RNA, 21 nt, Artificial Sequence
  Synthetic construct: hsa-miR-4732
gcccugaccuguccuguucug

SEQ ID NO: 1930 - RNA, 22 nt, Artificial Sequence
  Synthetic construct: hsa-miR-4733
aaucccaaugcuagacccggug

SEQ ID NO: 1931 - RNA, 22 nt, Artificial Sequence
  Synthetic construct: hsa-miR-4733
ccaccaggucuagcauugggau

SEQ ID NO: 1932 - RNA, 22 nt, Artificial Sequence
  Synthetic construct: hsa-miR-4734
gcugcgggcugcggucagggcg

SEQ ID NO: 1933 - RNA, 22 nt, Artificial Sequence
  Synthetic construct: hsa-miR-4734
cccugaccgcagcccgcagcuu

SEQ ID NO: 1934 - RNA, 22 nt, Artificial Sequence
  Synthetic construct: hsa-miR-4735
ccuaauuugaacaccuucggua

SEQ ID NO: 1935 - RNA, 21 nt, Artificial Sequence
  Synthetic construct: hsa-miR-4735
aaaggugcucaaauuagacau

SEQ ID NO: 1936 - RNA, 19 nt, Artificial Sequence
  Synthetic construct: hsa-miR-4736
aggcagguuaucugggcug

SEQ ID NO: 1937 - RNA, 19 nt, Artificial Sequence
  Synthetic construct: hsa-miR-4736
gcccagauaaccugccuuu

SEQ ID NO: 1938 - RNA, 20 nt, Artificial Sequence
  Synthetic construct: hsa-miR-4737
augcgaggaugcugacagug

SEQ ID NO: 1939 - RNA, 20 nt, Artificial Sequence
  Synthetic construct: hsa-miR-4737
cugucagcauccucgcauuu

SEQ ID NO: 1940 - RNA, 22 nt, Artificial Sequence
  Synthetic construct: hsa-miR-4738
ugaaacuggagcgccuggagga

SEQ ID NO: 1941 - RNA, 22 nt, Artificial Sequence
  Synthetic construct: hsa-miR-4738
accagcgcguuuucaguuucau

SEQ ID NO: 1942 - RNA, 25 nt, Artificial Sequence
  Synthetic construct: hsa-miR-4739
aagggaggaggagcggaggggcccu

SEQ ID NO: 1943 - RNA, 25 nt, Artificial Sequence
  Synthetic construct: hsa-miR-4739
ggccccuccgcuccuccucccuuuu

SEQ ID NO: 1944 - RNA, 22 nt, Artificial Sequence
  Synthetic construct: hsa-miR-4740
gcccgagaggauccgucccugc

SEQ ID NO: 1945 - RNA, 22 nt, Artificial Sequence
  Synthetic construct: hsa-miR-4740
aggacugauccucucgggcagg

SEQ ID NO: 1946 - RNA, 23 nt, Artificial Sequence
  Synthetic construct: hsa-miR-4741
cgggcuguccggaggggucggcu

SEQ ID NO: 1947 - RNA, 23 nt, Artificial Sequence
  Synthetic construct: hsa-miR-4741
ccgaccccuccggacagcccguu

SEQ ID NO: 1948 - RNA, 23 nt, Artificial Sequence
  Synthetic construct: hsa-miR-4742
ucaggcaaagggauauuuacaga

SEQ ID NO: 1949 - RNA, 23 nt, Artificial Sequence
  Synthetic construct: hsa-miR-4742
ucuguauucuccuuugccugcag

SEQ ID NO: 1950 - RNA, 21 nt, Artificial Sequence
  Synthetic construct: hsa-miR-4743
uuucugucuuuucugguccag

SEQ ID NO: 1951 - RNA, 23 nt, Artificial Sequence
  Synthetic construct: hsa-miR-4743
uggccggaugggacaggaggcau

SEQ ID NO: 1952 - RNA, 23 nt, Artificial Sequence
  Synthetic construct: hsa-miR-4744
ucuaaagacuagacuucgcuaug

SEQ ID NO: 1953 - RNA, 23 nt, Artificial Sequence
  Synthetic construct: hsa-miR-4744
uagcgaagucuagucuuuagauu

SEQ ID NO: 1954 - RNA, 23 nt, Artificial Sequence
  Synthetic construct: hsa-miR-4745
ugaguggggcucccgggacggcg

SEQ ID NO: 1955 - RNA, 23 nt, Artificial Sequence
  Synthetic construct: hsa-miR-4745
uggcccggcgacgucucacgguc

SEQ ID NO: 1956 - RNA, 21 nt, Artificial Sequence
  Synthetic construct: hsa-miR-4746
agcggugcuccugcgggccga

SEQ ID NO: 1957 - RNA, 23 nt, Artificial Sequence
  Synthetic construct: hsa-miR-4746
ccggucccaggagaaccugcaga

SEQ ID NO: 1958 - RNA, 22 nt, Artificial Sequence
  Synthetic construct: hsa-miR-4747
aaggcccgggcuuuccucccag

SEQ ID NO: 1959 - RNA, 22 nt, Artificial Sequence
  Synthetic construct: hsa-miR-4747
agggaaggaggcuuggucuuag

SEQ ID NO: 1960 - RNA, 21 nt, Artificial Sequence
  Synthetic construct: hsa-miR-4748
gagguuuggggaggauuugcu

SEQ ID NO: 1961 - RNA, 21 nt, Artificial Sequence
  Synthetic construct: hsa-miR-4748
caaauccuccccaaaccucuu

SEQ ID NO: 1962 - RNA, 22 nt, Artificial Sequence
  Synthetic construct: hsa-miR-4749
ugcggggacaggccagggcauc

SEQ ID NO: 1963 - RNA, 20 nt, Artificial Sequence
  Synthetic construct: hsa-miR-4749
cgccccuccugcccccacag

SEQ ID NO: 1964 - RNA, 22 nt, Artificial Sequence
  Synthetic construct: hsa-miR-4750
ccugacccacccccucccgcag

SEQ ID NO: 1965 - RNA, 22 nt, Artificial Sequence
  Synthetic construct: hsa-miR-4750
cucgggcggaggugguugagug

SEQ ID NO: 1966 - RNA, 24 nt, Artificial Sequence
  Synthetic construct: hsa-miR-4751
agaggacccguagcugcuagaagg

SEQ ID NO: 1967 - RNA, 24 nt, Artificial Sequence
  Synthetic construct: hsa-miR-4751
uucuagcagcuacggguccucuuu

SEQ ID NO: 1968 - RNA, 22 nt, Artificial Sequence
  Synthetic construct: hsa-miR-4752
uuguggaucucaaggaugugcu

SEQ ID NO: 1969 - RNA, 22 nt, Artificial Sequence
  Synthetic construct: hsa-miR-4752
cacauccuugagauccacaauu

SEQ ID NO: 1970 - RNA, 22 nt, Artificial Sequence
  Synthetic construct: hsa-miR-4753
caaggccaaaggaagagaacag

SEQ ID NO: 1971 - RNA, 22 nt, Artificial Sequence
  Synthetic construct: hsa-miR-4753
uucucuuucuuuagccuugugu

SEQ ID NO: 1972 - RNA, 23 nt, Artificial Sequence
  Synthetic construct: hsa-miR-4754
augcggaccuggguuagcggagu

SEQ ID NO: 1973 - RNA, 23 nt, Artificial Sequence
  Synthetic construct: hsa-miR-4754
uccgcuaacccagguccgcauuu

SEQ ID NO: 1974 - RNA, 22 nt, Artificial Sequence
  Synthetic construct: hsa-miR-4755
uuucccuucagagccuggcuuu

SEQ ID NO: 1975 - RNA, 22 nt, Artificial Sequence
  Synthetic construct: hsa-miR-4755
agccaggcucugaagggaaagu

SEQ ID NO: 1976 - RNA, 22 nt, Artificial Sequence
  Synthetic construct: hsa-miR-4756
ccagagaugguugccuuccuau

SEQ ID NO: 1977 - RNA, 23 nt, Artificial Sequence
  Synthetic construct: hsa-miR-4756
cagggaggcgcucacucucugcu

SEQ ID NO: 1978 - RNA, 22 nt, Artificial Sequence
  Synthetic construct: hsa-miR-4757
caugacgucacagaggcuucgc

SEQ ID NO: 1979 - RNA, 23 nt, Artificial Sequence
  Synthetic construct: hsa-miR-4757
aggccucugugacgucacggugu

SEQ ID NO: 1980 - RNA, 23 nt, Artificial Sequence
  Synthetic construct: hsa-miR-4758
gugagugggagccgguggggcug

SEQ ID NO: 1981 - RNA, 23 nt, Artificial Sequence
  Synthetic construct: hsa-miR-4758
ugccccaccugcugaccacccuc

SEQ ID NO: 1982 - RNA, 21 nt, Artificial Sequence
  Synthetic construct: hsa-miR-4759
uaggacuagauguuggaauua

SEQ ID NO: 1983 - RNA, 21 nt, Artificial Sequence
  Synthetic construct: hsa-miR-4759
auuccaacaucuaguccuauu

SEQ ID NO: 1984 - RNA, 22 nt, Artificial Sequence
  Synthetic construct: hsa-miR-4760
aaauucauguucaaucuaaacc

SEQ ID NO: 1985 - RNA, 22 nt, Artificial Sequence
  Synthetic construct: hsa-miR-4760
uuuagauugaacaugaaguuag

SEQ ID NO: 1986 - RNA, 21 nt, Artificial Sequence
  Synthetic construct: hsa-miR-4761
acaaggugugcaugccugacc

SEQ ID NO: 1987 - RNA, 21 nt, Artificial Sequence
  Synthetic construct: hsa-miR-4761
gagggcaugcgcacuuugucc

SEQ ID NO: 1988 - RNA, 21 nt, Artificial Sequence
  Synthetic construct: hsa-miR-4762
ccaaaucuugaucagaagccu

SEQ ID NO: 1989 - RNA, 22 nt, Artificial Sequence
  Synthetic construct: hsa-miR-4762
cuucugaucaagauuuguggug

SEQ ID NO: 1990 - RNA, 24 nt, Artificial Sequence
  Synthetic construct: hsa-miR-4763
aggcaggggcuggugcugggcggg

SEQ ID NO: 1991 - RNA, 21 nt, Artificial Sequence
  Synthetic construct: hsa-miR-4763
cgccugcccagcccuccugcu

SEQ ID NO: 1992 - RNA, 22 nt, Artificial Sequence
  Synthetic construct: hsa-miR-4764
uuaacuccuuucacacccaugg

SEQ ID NO: 1993 - RNA, 21 nt, Artificial Sequence
  Synthetic construct: hsa-miR-4764
uggauguggaaggaguuaucu

SEQ ID NO: 1994 - RNA, 22 nt, Artificial Sequence
  Synthetic construct: hsa-miR-4765
ugagugauugauagcuauguuc

SEQ ID NO: 1995 - RNA, 22 nt, Artificial Sequence
  Synthetic construct: hsa-miR-4765
acauagcuaucaaucacucauu

SEQ ID NO: 1996 - RNA, 21 nt, Artificial Sequence
  Synthetic construct: hsa-miR-4766
ucugaaagagcaguugguguu

SEQ ID NO: 1997 - RNA, 21 nt, Artificial Sequence
  Synthetic construct: hsa-miR-4766
auagcaauugcucuuuuggaa

SEQ ID NO: 1998 - RNA, 23 nt, Artificial Sequence
  Synthetic construct: hsa-miR-4767
cgcgggcgcuccuggccgccgcc

SEQ ID NO: 1999 - RNA, 23 nt, Artificial Sequence
  Synthetic construct: hsa-miR-4767
cggcggccaggagcgcccgcguu

SEQ ID NO: 2000 - RNA, 20 nt, Artificial Sequence
  Synthetic construct: hsa-miR-4768
ccaggagauccagagagaau

SEQ ID NO: 2001 - RNA, 22 nt, Artificial Sequence
  Synthetic construct: hsa-miR-4768
auucucucuggaucccauggau

SEQ ID NO: 2002 - RNA, 22 nt, Artificial Sequence
  Synthetic construct: hsa-miR-4769
ucugccauccucccuccccuac

SEQ ID NO: 2003 - RNA, 24 nt, Artificial Sequence
  Synthetic construct: hsa-miR-4769
ggugggauggagagaagguaugag

SEQ ID NO: 2004 - RNA, 18 nt, Artificial Sequence
  Synthetic construct: hsa-miR-4770
ugagaugacacuguagcu

SEQ ID NO: 2005 - RNA, 18 nt, Artificial Sequence
  Synthetic construct: hsa-miR-4770
cuacagugucaucucauu

SEQ ID NO: 2006 - RNA, 21 nt, Artificial Sequence
  Synthetic construct: hsa-miR-4771
agcagacuugaccuacaauua

SEQ ID NO: 2007 - RNA, 21 nt, Artificial Sequence
  Synthetic construct: hsa-miR-4771
auuguaggucaagucugcuuu

SEQ ID NO: 2008 - RNA, 22 nt, Artificial Sequence
  Synthetic construct: hsa-miR-4772
ccugcaacuuugccugaucaga

SEQ ID NO: 2009 - RNA, 22 nt, Artificial Sequence
  Synthetic construct: hsa-miR-4772
ugaucaggcaaaauugcagacu

SEQ ID NO: 2010 - RNA, 22 nt, Artificial Sequence
  Synthetic construct: hsa-miR-4773
cagaacaggagcauagaaaggc

SEQ ID NO: 2011 - RNA, 22 nt, Artificial Sequence
  Synthetic construct: hsa-miR-4773
cuuucuaugcuccuguucuguu

SEQ ID NO: 2012 - RNA, 21 nt, Artificial Sequence
  Synthetic construct: hsa-miR-4774
auugccuaacaugugccagaa

SEQ ID NO: 2013 - RNA, 22 nt, Artificial Sequence
  Synthetic construct: hsa-miR-4774
ucugguauguaguagguaauaa

SEQ ID NO: 2014 - RNA, 22 nt, Artificial Sequence
  Synthetic construct: hsa-miR-4775
uuaauuuuuuguuucggucacu

SEQ ID NO: 2015 - RNA, 22 nt, Artificial Sequence
  Synthetic construct: hsa-miR-4775
ugaccgaaacaaaaaauuaauu

SEQ ID NO: 2016 - RNA, 22 nt, Artificial Sequence
  Synthetic construct: hsa-miR-4776
guggaccaggauggcaagggcu

SEQ ID NO: 2017 - RNA, 23 nt, Artificial Sequence
  Synthetic construct: hsa-miR-4776
cuugccauccugguccacugcau

SEQ ID NO: 2018 - RNA, 22 nt, Artificial Sequence
  Synthetic construct: hsa-miR-4777
uucuagaugagagauauauaua

SEQ ID NO: 2019 - RNA, 22 nt, Artificial Sequence
  Synthetic construct: hsa-miR-4777
auaccucaucuagaaugcugua

SEQ ID NO: 2020 - RNA, 22 nt, Artificial Sequence
  Synthetic construct: hsa-miR-4778
ucuucuuccuuugcagaguuga

SEQ ID NO: 2021 - RNA, 22 nt, Artificial Sequence
  Synthetic construct: hsa-miR-4778
aauucuguaaaggaagaagagg

SEQ ID NO: 2022 - RNA, 22 nt, Artificial Sequence
  Synthetic construct: hsa-miR-4779
uaggagggaauaguaaaagcag

SEQ ID NO: 2023 - RNA, 22 nt, Artificial Sequence
  Synthetic construct: hsa-miR-4779
gcuuuuacuauucccuccuauu

SEQ ID NO: 2024 - RNA, 22 nt, Artificial Sequence
  Synthetic construct: hsa-miR-4780
acccuugagccugaucccuagc

SEQ ID NO: 2025 - RNA, 22 nt, Artificial Sequence
  Synthetic construct: hsa-miR-4780
uagggaucaggcucaaggguuu

SEQ ID NO: 2026 - RNA, 21 nt, Artificial Sequence
  Synthetic construct: hsa-miR-4781
uagcggggauuccaauauugg

SEQ ID NO: 2027 - RNA, 22 nt, Artificial Sequence
  Synthetic construct: hsa-miR-4781
aauguuggaauccucgcuagag

SEQ ID NO: 2028 - RNA, 22 nt, Artificial Sequence
  Synthetic construct: hsa-miR-4782
ugauugucuucauaucuagaac

SEQ ID NO: 2029 - RNA, 22 nt, Artificial Sequence
  Synthetic construct: hsa-miR-4782
uucuggauaugaagacaaucaa

SEQ ID NO: 2030 - RNA, 23 nt, Artificial Sequence
  Synthetic construct: hsa-miR-4783
ccccgguguuggggcgcgucugc

SEQ ID NO: 2031 - RNA, 21 nt, Artificial Sequence
  Synthetic construct: hsa-miR-4783
ggcgcgcccagcucccgggcu

SEQ ID NO: 2032 - RNA, 20 nt, Artificial Sequence
  Synthetic construct: hsa-miR-4784
ugaggagaugcugggacuga

SEQ ID NO: 2033 - RNA, 20 nt, Artificial Sequence
  Synthetic construct: hsa-miR-4784
agucccagcaucuccucauu

SEQ ID NO: 2034 - RNA, 21 nt, Artificial Sequence
  Synthetic construct: hsa-miR-4785
agagucggcgacgccgccagc

SEQ ID NO: 2035 - RNA, 21 nt, Artificial Sequence
  Synthetic construct: hsa-miR-4785
uggcggcgucgccgacucuuu

SEQ ID NO: 2036 - RNA, 22 nt, Artificial Sequence
  Synthetic construct: hsa-miR-4786
ugaagccagcucuggucugggc

SEQ ID NO: 2037 - RNA, 22 nt, Artificial Sequence
  Synthetic construct: hsa-miR-4786
ugagaccaggacuggaugcacc

SEQ ID NO: 2038 - RNA, 24 nt, Artificial Sequence
  Synthetic construct: hsa-miR-4787
gaugcgccgcccacugccccgcgc

SEQ ID NO: 2039 - RNA, 22 nt, Artificial Sequence
  Synthetic construct: hsa-miR-4787
gcggggguggcggcggcauccc

SEQ ID NO: 2040 - RNA, 22 nt, Artificial Sequence
  Synthetic construct: hsa-miR-4788
uuacggaccagcuaagggaggc

SEQ ID NO: 2041 - RNA, 22 nt, Artificial Sequence
  Synthetic construct: hsa-miR-4788
cucccuuagcugguccguaauu

SEQ ID NO: 2042 - RNA, 22 nt, Artificial Sequence
  Synthetic construct: hsa-miR-4789
guauacaccugauauguguaug

SEQ ID NO: 2043 - RNA, 21 nt, Artificial Sequence
  Synthetic construct: hsa-miR-4789
cacacauagcagguguauaua

SEQ ID NO: 2044 - RNA, 20 nt, Artificial Sequence
  Synthetic construct: hsa-miR-4790
aucgcuuuaccauucauguu

SEQ ID NO: 2045 - RNA, 22 nt, Artificial Sequence
  Synthetic construct: hsa-miR-4790
ugaaugguaaagcgaugucaca

SEQ ID NO: 2046 - RNA, 18 nt, Artificial Sequence
  Synthetic construct: hsa-miR-4791
uggauaugaugacugaaa

SEQ ID NO: 2047 - RNA, 18 nt, Artificial Sequence
  Synthetic construct: hsa-miR-4791
ucagucaucauauccauu

SEQ ID NO: 2048 - RNA, 18 nt, Artificial Sequence
  Synthetic construct: hsa-miR-4792
cggugagcgcucgcuggc

SEQ ID NO: 2049 - RNA, 18 nt, Artificial Sequence
  Synthetic construct: hsa-miR-4792
cagcgagcgcucaccguu

SEQ ID NO: 2050 - RNA, 24 nt, Artificial Sequence
  Synthetic construct: hsa-miR-4793
acauccugcuccacagggcagagg

SEQ ID NO: 2051 - RNA, 23 nt, Artificial Sequence
  Synthetic construct: hsa-miR-4793
ucugcacugugaguuggcuggcu

SEQ ID NO: 2052 - RNA, 22 nt, Artificial Sequence
  Synthetic construct: hsa-miR-4794
ucuggcuaucucacgagacugu

SEQ ID NO: 2053 - RNA, 22 nt, Artificial Sequence
  Synthetic construct: hsa-miR-4794
agucucgugagauagccagauu

SEQ ID NO: 2054 - RNA, 21 nt, Artificial Sequence
  Synthetic construct: hsa-miR-4795
agaaguggcuaauaauauuga

SEQ ID NO: 2055 - RNA, 22 nt, Artificial Sequence
  Synthetic construct: hsa-miR-4795
auauuauuagccacuucuggau

SEQ ID NO: 2056 - RNA, 22 nt, Artificial Sequence
  Synthetic construct: hsa-miR-4796
uaaaguggcagaguauagacac

SEQ ID NO: 2057 - RNA, 22 nt, Artificial Sequence
  Synthetic construct: hsa-miR-4796
ugucuauacucugucacuuuac

SEQ ID NO: 2058 - RNA, 21 nt, Artificial Sequence
  Synthetic construct: hsa-miR-4797
gacagagugccacuuacugaa

SEQ ID NO: 2059 - RNA, 21 nt, Artificial Sequence
  Synthetic construct: hsa-miR-4797
ucucaguaaguggcacucugu

SEQ ID NO: 2060 - RNA, 22 nt, Artificial Sequence
  Synthetic construct: hsa-miR-4798
uucgguauacuuugugaauugg

SEQ ID NO: 2061 - RNA, 22 nt, Artificial Sequence
  Synthetic construct: hsa-miR-4798
aacucacgaaguauaccgaagu

SEQ ID NO: 2062 - RNA, 22 nt, Artificial Sequence
  Synthetic construct: hsa-miR-4799
aucuaaaugcagcaugccaguc

SEQ ID NO: 2063 - RNA, 22 nt, Artificial Sequence
  Synthetic construct: hsa-miR-4799
acuggcaugcugcauuuauaua

SEQ ID NO: 2064 - RNA, 19 nt, Artificial Sequence
  Synthetic construct: hsa-miR-4800
cauccguccgucuguccac

SEQ ID NO: 2065 - RNA, 21 nt, Artificial Sequence
  Synthetic construct: hsa-miR-4800
aguggaccgaggaaggaagga

SEQ ID NO: 2066 - RNA, 22 nt, Artificial Sequence
  Synthetic construct: hsa-miR-4801
uacacaagaaaaccaaggcuca

SEQ ID NO: 2067 - RNA, 22 nt, Artificial Sequence
  Synthetic construct: hsa-miR-4801
agccuugguuuucuuguguauu

SEQ ID NO: 2068 - RNA, 22 nt, Artificial Sequence
  Synthetic construct: hsa-miR-4802
uauggagguucuagaccauguu

SEQ ID NO: 2069 - RNA, 23 nt, Artificial Sequence
  Synthetic construct: hsa-miR-4802
uacauggauggaaaccuucaagc

SEQ ID NO: 2070 - RNA, 21 nt, Artificial Sequence
  Synthetic construct: hsa-miR-4803
uaacauaauaguguggauuga

SEQ ID NO: 2071 - RNA, 21 nt, Artificial Sequence
  Synthetic construct: hsa-miR-4803
aauccacacuauuauguuauu

SEQ ID NO: 2072 - RNA, 21 nt, Artificial Sequence
  Synthetic construct: hsa-miR-4804
ugcuuaaccuugcccucgaaa

SEQ ID NO: 2073 - RNA, 21 nt, Artificial Sequence
  Synthetic construct: hsa-miR-4804
uuggacgguaagguuaagcaa

SEQ ID NO: 2074 - RNA, 21 nt, Artificial Sequence
  Synthetic construct: hsa-miR-483
ucacuccucuccucccgucuu

SEQ ID NO: 2075 - RNA, 22 nt, Artificial Sequence
  Synthetic construct: hsa-miR-483
aagacgggaggaaagaagggag

SEQ ID NO: 2076 - RNA, 22 nt, Artificial Sequence
  Synthetic construct: hsa-miR-484
ucaggcucaguccccucccgau

SEQ ID NO: 2077 - RNA, 22 nt, Artificial Sequence
  Synthetic construct: hsa-miR-484
cgggaggggacugagccugauu

SEQ ID NO: 2078 - RNA, 22 nt, Artificial Sequence
  Synthetic construct: hsa-miR-485
agaggcuggccgugaugaauuc

SEQ ID NO: 2079 - RNA, 22 nt, Artificial Sequence
  Synthetic construct: hsa-miR-485
gucauacacggcucuccucucu

SEQ ID NO: 2080 - RNA, 21 nt, Artificial Sequence
  Synthetic construct: hsa-miR-486
cggggcagcucaguacaggau

SEQ ID NO: 2081 - RNA, 22 nt, Artificial Sequence
  Synthetic construct: hsa-miR-486
uccuguacugagcugccccgag

SEQ ID NO: 2082 - RNA, 22 nt, Artificial Sequence
  Synthetic construct: hsa-miR-487a
gugguuaucccugcuguguucg

SEQ ID NO: 2083 - RNA, 22 nt, Artificial Sequence
  Synthetic construct: hsa-miR-487a
aaucauacagggacauccaguu

SEQ ID NO: 2084 - RNA, 22 nt, Artificial Sequence
  Synthetic construct: hsa-miR-487b
gugguuaucccuguccuguucg

SEQ ID NO: 2085 - RNA, 22 nt, Artificial Sequence
  Synthetic construct: hsa-miR-487b
aaucguacagggucauccacuu

SEQ ID NO: 2086 - RNA, 21 nt, Artificial Sequence
  Synthetic construct: hsa-miR-488
uugaaaggcuauuucuugguc

SEQ ID NO: 2087 - RNA, 21 nt, Artificial Sequence
  Synthetic construct: hsa-miR-488
cccagauaauggcacucucaa

SEQ ID NO: 2088 - RNA, 22 nt, Artificial Sequence
  Synthetic construct: hsa-miR-489
gugacaucacauauacggcagc

SEQ ID NO: 2089 - RNA, 22 nt, Artificial Sequence
  Synthetic construct: hsa-miR-489
ggucguaugugugacgccauuu

SEQ ID NO: 2090 - RNA, 20 nt, Artificial Sequence
  Synthetic construct:
ccauggaucuccaggugggu

SEQ ID NO: 2091 - RNA, 22 nt, Artificial Sequence
  Synthetic construct: hsa-miR-490
caaccuggaggacuccaugcug

SEQ ID NO: 2092 - RNA, 22 nt, Artificial Sequence
  Synthetic construct: hsa-miR-491
aguggggaacccuuccaugagg

SEQ ID NO: 2093 - RNA, 22 nt, Artificial Sequence
  Synthetic construct: hsa-miR-491
cuuaugcaagauucccuucuac

SEQ ID NO: 2094 - RNA, 23 nt, Artificial Sequence
  Synthetic construct: hsa-miR-492
aggaccugcgggacaagauucuu

SEQ ID NO: 2095 - RNA, 23 nt, Artificial Sequence
  Synthetic construct: hsa-miR-492
gaaucuugucccgcagguccuuu

SEQ ID NO: 2096 - RNA, 22 nt, Artificial Sequence
  Synthetic construct: hsa-miR-493
ugaaggucuacugugugccagg

SEQ ID NO: 2097 - RNA, 22 nt, Artificial Sequence
  Synthetic construct: hsa-miR-493
uuguacaugguaggcuuucauu

SEQ ID NO: 2098 - RNA, 23 nt, Artificial Sequence
  Synthetic construct: hsa-miR-494
agguuguccguguugucuucucu

SEQ ID NO: 2099 - RNA, 22 nt, Artificial Sequence
  Synthetic construct: hsa-miR-494
ugaaacauacacgggaaaccuc

SEQ ID NO: 2100 - RNA, 22 nt, Artificial Sequence
  Synthetic construct: hsa-miR-495
gaaguugcccauguuauuuucg

SEQ ID NO: 2101 - RNA, 22 nt, Artificial Sequence
  Synthetic construct: hsa-miR-495
aaacaaacauggugcacuucuu

SEQ ID NO: 2102 - RNA, 22 nt, Artificial Sequence
  Synthetic construct: hsa-miR-496
ugaguauuacauggccaaucuc

SEQ ID NO: 2103 - RNA, 22 nt, Artificial Sequence
  Synthetic construct: hsa-miR-496
gauuggccauguaauacucauu

SEQ ID NO: 2104 - RNA, 21 nt, Artificial Sequence
  Synthetic construct: hsa-miR-497
cagcagcacacugugguuugu

SEQ ID NO: 2105 - RNA, 22 nt, Artificial Sequence
  Synthetic construct: hsa-miR-497
caaaccacacugugguguuaga

SEQ ID NO: 2106 - RNA, 23 nt, Artificial Sequence
  Synthetic construct: hsa-miR-498
uuucaagccagggggcguuuuuc

SEQ ID NO: 2107 - RNA, 23 nt, Artificial Sequence
  Synthetic construct: hsa-miR-498
aaaacgcccccuggcuugaaauu

SEQ ID NO: 2108 - RNA, 21 nt, Artificial Sequence
  Synthetic construct: hsa-miR-4999
ugcuguauugucagguaguga

SEQ ID NO: 2109 - RNA, 20 nt, Artificial Sequence
  Synthetic construct: hsa-miR-4999
ucacuaccugacaauacagu

SEQ ID NO: 2110 - RNA, 21 nt, Artificial Sequence
  Synthetic construct: hsa-miR-499a
uuaagacuugcagugauguuu

SEQ ID NO: 2111 - RNA, 22 nt, Artificial Sequence
  Synthetic construct: hsa-miR-499a
aacaucacagcaagucugugcu

SEQ ID NO: 2112 - RNA, 21 nt, Artificial Sequence
  Synthetic construct: hsa-miR-499b
acagacuugcugugauguuca

SEQ ID NO: 2113 - RNA, 22 nt, Artificial Sequence
  Synthetic construct: hsa-miR-499b
aacaucacugcaagucuuaaca

SEQ ID NO: 2114 - RNA, 22 nt, Artificial Sequence
  Synthetic construct: hsa-miR-5000
ucaggacacuucugaacuugga

SEQ ID NO: 2115 - RNA, 22 nt, Artificial Sequence
  Synthetic construct: hsa-miR-5000
caguucagaaguguuccugagu

SEQ ID NO: 2116 - RNA, 24 nt, Artificial Sequence
  Synthetic construct: hsa-miR-5001
agggcuggacucagcggcggagcu

SEQ ID NO: 2117 - RNA, 22 nt, Artificial Sequence
  Synthetic construct: hsa-miR-5001
uucugccucuguccagguccuu

SEQ ID NO: 2118 - RNA, 21 nt, Artificial Sequence
  Synthetic construct: hsa-miR-5002
ugacugccucacugaccacuu

SEQ ID NO: 2119 - RNA, 24 nt, Artificial Sequence
  Synthetic construct: hsa-miR-5002
aauuugguuucugaggcacuuagu

SEQ ID NO: 2120 - RNA, 23 nt, Artificial Sequence
  Synthetic construct: hsa-miR-5003
ucacaacaaccuugcaggguaga

SEQ ID NO: 2121 - RNA, 21 nt, Artificial Sequence
  Synthetic construct: hsa-miR-5003
uacuuuucuagguuguugggg

SEQ ID NO: 2122 - RNA, 22 nt, Artificial Sequence
  Synthetic construct: hsa-miR-5004
cuuggauuuuccugggccucag

SEQ ID NO: 2123 - RNA, 22 nt, Artificial Sequence
  Synthetic construct: hsa-miR-5004
ugaggacagggcaaauucacga

SEQ ID NO: 2124 - RNA, 21 nt, Artificial Sequence
  Synthetic construct: hsa-miR-5006
uugccagggcaggagguggaa

SEQ ID NO: 2125 - RNA, 21 nt, Artificial Sequence
  Synthetic construct: hsa-miR-5006
uuucccuuuccauccuggcag

SEQ ID NO: 2126 - RNA, 22 nt, Artificial Sequence
  Synthetic construct: hsa-miR-5007
uagagucuggcugauaugguuu

SEQ ID NO: 2127 - RNA, 22 nt, Artificial Sequence
  Synthetic construct: hsa-miR-5007
aucauaugaaccaaacucuaau

SEQ ID NO: 2128 - RNA, 22 nt, Artificial Sequence
  Synthetic construct: hsa-miR-5008
ugaggcccuuggggcacagugg

SEQ ID NO: 2129 - RNA, 21 nt, Artificial Sequence
  Synthetic construct: hsa-miR-5008
ccugugcucccagggccucgc

SEQ ID NO: 2130 - RNA, 22 nt, Artificial Sequence
  Synthetic construct: hsa-miR-5009
uccuaaaucugaaaguccaaaa

SEQ ID NO: 2131 - RNA, 24 nt, Artificial Sequence
  Synthetic construct: hsa-miR-5009
uuggacuuuuucagauuuggggau

SEQ ID NO: 2132 - RNA, 22 nt, Artificial Sequence
  Synthetic construct: hsa-miR-500a
augcaccugggcaaggauucug

SEQ ID NO: 2133 - RNA, 23 nt, Artificial Sequence
  Synthetic construct: hsa-miR-500a
uaauccuugcuaccugggugaga

SEQ ID NO: 2134 - RNA, 18 nt, Artificial Sequence
  Synthetic construct: hsa-miR-500b
aauccuugcuaccugggu

SEQ ID NO: 2135 - RNA, 20 nt, Artificial Sequence
  Synthetic construct: hsa-miR-500b
gcacccaggcaaggauucug

SEQ ID NO: 2136 - RNA, 22 nt, Artificial Sequence
  Synthetic construct: hsa-miR-501
aaugcacccgggcaaggauucu

SEQ ID NO: 2137 - RNA, 22 nt, Artificial Sequence
  Synthetic construct: hsa-miR-501
aauccuuugucccugggugaga

SEQ ID NO: 2138 - RNA, 22 nt, Artificial Sequence
  Synthetic construct: hsa-miR-5010
agggggauggcagagcaaaauu

SEQ ID NO: 2139 - RNA, 22 nt, Artificial Sequence
  Synthetic construct: hsa-miR-5010
uuuugugucucccauuccccag

SEQ ID NO: 2140 - RNA, 21 nt, Artificial Sequence
  Synthetic construct: hsa-miR-5011
uauauauacagccaugcacuc

SEQ ID NO: 2141 - RNA, 22 nt, Artificial Sequence
  Synthetic construct: hsa-miR-5011
gugcauggcuguauauauaaca

SEQ ID NO: 2142 - RNA, 22 nt, Artificial Sequence
  Synthetic construct: hsa-miR-502
aaugcaccugggcaaggauuca

SEQ ID NO: 2143 - RNA, 21 nt, Artificial Sequence
  Synthetic construct: hsa-miR-502
auccuugcuaucugggugcua

SEQ ID NO: 2144 - RNA, 23 nt, Artificial Sequence
  Synthetic construct: hsa-miR-503
uagcagcgggaacaguucugcag

SEQ ID NO: 2145 - RNA, 23 nt, Artificial Sequence
  Synthetic construct: hsa-miR-503
gggguauuguuuccgcugccagg

SEQ ID NO: 2146 - RNA, 21 nt, Artificial Sequence
  Synthetic construct: hsa-miR-504
gggagugcagggcaggguuuc

SEQ ID NO: 2147 - RNA, 22 nt, Artificial Sequence
  Synthetic construct: hsa-miR-504
agacccuggucugcacucuauc

SEQ ID NO: 2148 - RNA, 21 nt, Artificial Sequence
  Synthetic construct: hsa-miR-5047
uugcagcugcgguuguaaggu

SEQ ID NO: 2149 - RNA, 21 nt, Artificial Sequence
  Synthetic construct: hsa-miR-5047
cuuacaaccgcagcugcaauu

SEQ ID NO: 2150 - RNA, 22 nt, Artificial Sequence
  Synthetic construct: hsa-miR-505
cgucaacacuugcugguuuccu

SEQ ID NO: 2151 - RNA, 22 nt, Artificial Sequence
  Synthetic construct: hsa-miR-505
gggagccaggaaguauugaugu

SEQ ID NO: 2152 - RNA, 21 nt, Artificial Sequence
  Synthetic construct: hsa-miR-506
uaaggcacccuucugaguaga

SEQ ID NO: 2153 - RNA, 22 nt, Artificial Sequence
  Synthetic construct: hsa-miR-506
uauucaggaagguguuacuuaa

SEQ ID NO: 2154 - RNA, 21 nt, Artificial Sequence
  Synthetic construct: hsa-miR-507
uuuugcaccuuuuggagugaa

SEQ ID NO: 2155 - RNA, 21 nt, Artificial Sequence
  Synthetic construct: hsa-miR-507
cacuccaaaaggugcaaaauu

SEQ ID NO: 2156 - RNA, 23 nt, Artificial Sequence
  Synthetic construct: hsa-miR-508
ugauuguagccuuuuggaguaga

SEQ ID NO: 2157 - RNA, 23 nt, Artificial Sequence
  Synthetic construct: hsa-miR-508
uacuccagagggcgucacucaug

SEQ ID NO: 2158 - RNA, 23 nt, Artificial Sequence
  Synthetic construct: hsa-miR-5087
ggguuuguagcuuugcuggcaug

SEQ ID NO: 2159 - RNA, 23 nt, Artificial Sequence
  Synthetic construct: hsa-miR-5087
ugccagcaaagcuacaaacccuu

SEQ ID NO: 2160 - RNA, 21 nt, Artificial Sequence
  Synthetic construct: hsa-miR-5088
ucccuucuuccugggcccuca

SEQ ID NO: 2161 - RNA, 24 nt, Artificial Sequence
  Synthetic construct: hsa-miR-5088
cagggcucagggauuggauggagg

SEQ ID NO: 2162 - RNA, 21 nt, Artificial Sequence
  Synthetic construct: hsa-miR-5089
gugggauuucugaguagcauc

SEQ ID NO: 2163 - RNA, 23 nt, Artificial Sequence
  Synthetic construct: hsa-miR-5089
augcuacucggaaaucccacuga

SEQ ID NO: 2164 - RNA, 22 nt, Artificial Sequence
  Synthetic construct: hsa-miR-509-1
ugauugguacgucuguggguag

SEQ ID NO: 2165 - RNA, 21 nt, Artificial Sequence
  Synthetic construct: hsa-miR-509-1
uacugcagacaguggcaauca

SEQ ID NO: 2166 - RNA, 22 nt, Artificial Sequence
  Synthetic construct: hsa-miR-509-3
ugauugguacgucuguggguag

SEQ ID NO: 2167 - RNA, 22 nt, Artificial Sequence
  Synthetic construct: hsa-miR-509-3
uacugcagacguggcaaucaug

SEQ ID NO: 2168 - RNA, 23 nt, Artificial Sequence
  Synthetic construct: hsa-miR-5090
ccggggcagauugguguagggug

SEQ ID NO: 2169 - RNA, 23 nt, Artificial Sequence
  Synthetic construct: hsa-miR-5090
cccuacaccaaucugccccgguu

SEQ ID NO: 2170 - RNA, 23 nt, Artificial Sequence
  Synthetic construct: hsa-miR-5091
acggagacgacaagacugugcug

SEQ ID NO: 2171 - RNA, 23 nt, Artificial Sequence
  Synthetic construct: hsa-miR-5091
gcacagucuugucgucuccguuu

SEQ ID NO: 2172 - RNA, 22 nt, Artificial Sequence
  Synthetic construct: hsa-miR-5092
aauccacgcugagcuuggcauc

SEQ ID NO: 2173 - RNA, 22 nt, Artificial Sequence
  Synthetic construct: hsa-miR-5092
ugccaagcucagcguggauuuu

SEQ ID NO: 2174 - RNA, 23 nt, Artificial Sequence
  Synthetic construct: hsa-miR-5093
aggaaaugaggcuggcuaggagc

SEQ ID NO: 2175 - RNA, 23 nt, Artificial Sequence
  Synthetic construct: hsa-miR-5093
uccuagccagccucauuuccuuu

SEQ ID NO: 2176 - RNA, 22 nt, Artificial Sequence
  Synthetic construct: hsa-miR-5094
aaucagugaaugccuugaaccu

SEQ ID NO: 2177 - RNA, 22 nt, Artificial Sequence
  Synthetic construct: hsa-miR-5094
guucaaggcauucacugauuuu

SEQ ID NO: 2178 - RNA, 21 nt, Artificial Sequence
  Synthetic construct: hsa-miR-5095
uuacaggcgugaaccaccgcg

SEQ ID NO: 2179 - RNA, 21 nt, Artificial Sequence
  Synthetic construct: hsa-miR-5095
cggugguucacgccuguaauu

SEQ ID NO: 2180 - RNA, 21 nt, Artificial Sequence
  Synthetic construct: hsa-miR-5096
guuucaccauguuggucaggc

SEQ ID NO: 2181 - RNA, 21 nt, Artificial Sequence
  Synthetic construct: hsa-miR-5096
cugaccaacauggugaaacuu

SEQ ID NO: 2182 - RNA, 22 nt, Artificial Sequence
  Synthetic construct: hsa-miR-510
uacucaggagaguggcaaucac

SEQ ID NO: 2183 - RNA, 21 nt, Artificial Sequence
  Synthetic construct: hsa-miR-510
auugaaaccucuaagagugga

SEQ ID NO: 2184 - RNA, 22 nt, Artificial Sequence
  Synthetic construct: hsa-miR-5100
uucagaucccagcggugccucu

SEQ ID NO: 2185 - RNA, 22 nt, Artificial Sequence
  Synthetic construct: hsa-miR-5100
aggcaccgcugggaucugaauu

SEQ ID NO: 2186 - RNA, 21 nt, Artificial Sequence
  Synthetic construct: hsa-miR-511
gugucuuuugcucugcaguca

SEQ ID NO: 2187 - RNA, 20 nt, Artificial Sequence
  Synthetic construct: hsa-miR-511
aauguguagcaaaagacaga

SEQ ID NO: 2188 - RNA, 22 nt, Artificial Sequence
  Synthetic construct: hsa-miR-512
aagugcugucauagcugagguc

SEQ ID NO: 2189 - RNA, 23 nt, Artificial Sequence
  Synthetic construct: hsa-miR-512
cacucagccuugagggcacuuuc

SEQ ID NO: 2190 - RNA, 23 nt, Artificial Sequence
  Synthetic construct: hsa-miR-513a
uaaauuucaccuuucugagaagg

SEQ ID NO: 2191 - RNA, 18 nt, Artificial Sequence
  Synthetic construct: hsa-miR-513a
uucacagggaggugucau

SEQ ID NO: 2192 - RNA, 22 nt, Artificial Sequence
  Synthetic construct: hsa-miR-513b
aaaugucaccuuuuugagagga

SEQ ID NO: 2193 - RNA, 22 nt, Artificial Sequence
  Synthetic construct: hsa-miR-513b
uucacaaggaggugucauuuau

SEQ ID NO: 2194 - RNA, 22 nt, Artificial Sequence
  Synthetic construct: hsa-miR-513c
uucucaaggaggugucguuuau

SEQ ID NO: 2195 - RNA, 23 nt, Artificial Sequence
  Synthetic construct: hsa-miR-513c
uaaauuucaccuuucugagaaga

SEQ ID NO: 2196 - RNA, 21 nt, Artificial Sequence
  Synthetic construct: hsa-miR-514a
auugacacuucugugaguaga

SEQ ID NO: 2197 - RNA, 23 nt, Artificial Sequence
  Synthetic construct: hsa-miR-514a
uacucuggagagugacaaucaug

SEQ ID NO: 2198 - RNA, 21 nt, Artificial Sequence
  Synthetic construct: hsa-miR-514b
auugacaccucugugagugga

SEQ ID NO: 2199 - RNA, 22 nt, Artificial Sequence
  Synthetic construct: hsa-miR-514b
uucucaagagggaggcaaucau

SEQ ID NO: 2200 - RNA, 22 nt, Artificial Sequence
  Synthetic construct: hsa-miR-515
gagugccuucuuuuggagcguu

SEQ ID NO: 2201 - RNA, 24 nt, Artificial Sequence
  Synthetic construct: hsa-miR-515
uucuccaaaagaaagcacuuucug

SEQ ID NO: 2202 - RNA, 23 nt, Artificial Sequence
  Synthetic construct: hsa-miR-516a
uucucgaggaaagaagcacuuuc

SEQ ID NO: 2203 - RNA, 18 nt, Artificial Sequence
  Synthetic construct: hsa-miR-516a
ugcuuccuuucagagggu

SEQ ID NO: 2204 - RNA, 22 nt, Artificial Sequence
  Synthetic construct: hsa-miR-516b
aucuggagguaagaagcacuuu

SEQ ID NO: 2205 - RNA, 18 nt, Artificial Sequence
  Synthetic construct: hsa-miR-516b
ugcuuccuuucagagggu

SEQ ID NO: 2206 - RNA, 22 nt, Artificial Sequence
  Synthetic construct: hsa-miR-517a
aucgugcaucccuuuagagugu

SEQ ID NO: 2207 - RNA, 22 nt, Artificial Sequence
  Synthetic construct: hsa-miR-517a
ccucuagauggaagcacugucu

SEQ ID NO: 2208 - RNA, 22 nt, Artificial Sequence
  Synthetic construct: hsa-miR-517b
aucgugcaucccuuuagagugu

SEQ ID NO: 2209 - RNA, 22 nt, Artificial Sequence
  Synthetic construct: hsa-miR-517b
ccucuagauggaagcacugucu

SEQ ID NO: 2210 - RNA, 22 nt, Artificial Sequence
  Synthetic construct: hsa-miR-517c
aucgugcauccuuuuagagugu

SEQ ID NO: 2211 - RNA, 22 nt, Artificial Sequence
  Synthetic construct: hsa-miR-517c
ccucuagauggaagcacugucu

SEQ ID NO: 2212 - RNA, 21 nt, Artificial Sequence
  Synthetic construct: hsa-miR-5186
agagauugguagaaaucaggu

SEQ ID NO: 2213 - RNA, 21 nt, Artificial Sequence
  Synthetic construct: hsa-miR-5186
cugauuucuaccaaucucuuu

SEQ ID NO: 2214 - RNA, 21 nt, Artificial Sequence
  Synthetic construct: hsa-miR-5187
acugaauccucuuuuccucag

SEQ ID NO: 2215 - RNA, 22 nt, Artificial Sequence
  Synthetic construct: hsa-miR-5187
ugggaugagggauugaagugga

SEQ ID NO: 2216 - RNA, 23 nt, Artificial Sequence
  Synthetic construct: hsa-miR-5188
aaucggacccauuuaaaccggag

SEQ ID NO: 2217 - RNA, 23 nt, Artificial Sequence
  Synthetic construct: hsa-miR-5188
ccgguuuaaauggguccgauuuu

SEQ ID NO: 2218 - RNA, 24 nt, Artificial Sequence
  Synthetic construct: hsa-miR-5189
ucugggcacaggcggauggacagg

SEQ ID NO: 2219 - RNA, 21 nt, Artificial Sequence
  Synthetic construct: hsa-miR-5189
ugccaaccgucagagcccaga

SEQ ID NO: 2220 - RNA, 22 nt, Artificial Sequence
  Synthetic construct: hsa-miR-518a
gaaagcgcuucccuuugcugga

SEQ ID NO: 2221 - RNA, 20 nt, Artificial Sequence
  Synthetic construct: hsa-miR-518a
cugcaaagggaagcccuuuc

SEQ ID NO: 2222 - RNA, 22 nt, Artificial Sequence
  Synthetic construct: hsa-miR-518b
caaagcgcuccccuuuagaggu

SEQ ID NO: 2223 - RNA, 22 nt, Artificial Sequence
  Synthetic construct: hsa-miR-518b
cucuaaaggggagcgcuuuguu

SEQ ID NO: 2224 - RNA, 23 nt, Artificial Sequence
  Synthetic construct: hsa-miR-518c
caaagcgcuucucuuuagagugu

SEQ ID NO: 2225 - RNA, 23 nt, Artificial Sequence
  Synthetic construct: hsa-miR-518c
ucucuggagggaagcacuuucug

SEQ ID NO: 2226 - RNA, 22 nt, Artificial Sequence
  Synthetic construct: hsa-miR-518d
cucuagagggaagcacuuucug

SEQ ID NO: 2227 - RNA, 21 nt, Artificial Sequence
  Synthetic construct: hsa-miR-518d
caaagcgcuucccuuuggagc

SEQ ID NO: 2228 - RNA, 22 nt, Artificial Sequence
  Synthetic construct: hsa-miR-518e
cucuagagggaagcgcuuucug

SEQ ID NO: 2229 - RNA, 21 nt, Artificial Sequence
  Synthetic construct: hsa-miR-518e
aaagcgcuucccuucagagug

SEQ ID NO: 2230 - RNA, 22 nt, Artificial Sequence
  Synthetic construct: hsa-miR-518f
cucuagagggaagcacuuucuc

SEQ ID NO: 2231 - RNA, 21 nt, Artificial Sequence
  Synthetic construct: hsa-miR-518f
gaaagcgcuucucuuuagagg

SEQ ID NO: 2232 - RNA, 21 nt, Artificial Sequence
  Synthetic construct: hsa-miR-5190
ccagugacugagcuggagcca

SEQ ID NO: 2233 - RNA, 21 nt, Artificial Sequence
  Synthetic construct: hsa-miR-5190
gcuccagcucagucacugguu

SEQ ID NO: 2234 - RNA, 22 nt, Artificial Sequence
  Synthetic construct: hsa-miR-5191
aggauaggaagaaugaagugcu

SEQ ID NO: 2235 - RNA, 22 nt, Artificial Sequence
  Synthetic construct: hsa-miR-5191
cacuucauucuuccuauccuuu

SEQ ID NO: 2236 - RNA, 22 nt, Artificial Sequence
  Synthetic construct: hsa-miR-5192
aggagaguggauuccagguggu

SEQ ID NO: 2237 - RNA, 22 nt, Artificial Sequence
  Synthetic construct: hsa-miR-5192
caccuggaauccacucuccuuu

SEQ ID NO: 2238 - RNA, 22 nt, Artificial Sequence
  Synthetic construct: hsa-miR-5193
uccuccucuaccucaucccagu

SEQ ID NO: 2239 - RNA, 22 nt, Artificial Sequence
  Synthetic construct: hsa-miR-5193
ugggaugagguagaggaggauu

SEQ ID NO: 2240 - RNA, 22 nt, Artificial Sequence
  Synthetic construct: hsa-miR-5194
ugagggguuuggaaugggaugg

SEQ ID NO: 2241 - RNA, 22 nt, Artificial Sequence
  Synthetic construct: hsa-miR-5194
aucccauuccaaaccccucauu

SEQ ID NO: 2242 - RNA, 22 nt, Artificial Sequence
  Synthetic construct: hsa-miR-5195
aaccccuaaggcaacuggaugg

SEQ ID NO: 2243 - RNA, 21 nt, Artificial Sequence
  Synthetic construct: hsa-miR-5195
auccaguucucugagggggcu

SEQ ID NO: 2244 - RNA, 22 nt, Artificial Sequence
  Synthetic construct: hsa-miR-5196
agggaaggggacgaggguuggg

SEQ ID NO: 2245 - RNA, 21 nt, Artificial Sequence
  Synthetic construct: hsa-miR-5196
ucauccucgucucccucccag

SEQ ID NO: 2246 - RNA, 23 nt, Artificial Sequence
  Synthetic construct: hsa-miR-5197
aagaagagacugagucaucgaau

SEQ ID NO: 2247 - RNA, 23 nt, Artificial Sequence
  Synthetic construct: hsa-miR-5197
caauggcacaaacucauucuuga

SEQ ID NO: 2248 - RNA, 22 nt, Artificial Sequence
  Synthetic construct: hsa-miR-519a
cucuagagggaagcgcuuucug

SEQ ID NO: 2249 - RNA, 22 nt, Artificial Sequence
  Synthetic construct: hsa-miR-519a
aaagugcauccuuuuagagugu

SEQ ID NO: 2250 - RNA, 22 nt, Artificial Sequence
  Synthetic construct: hsa-miR-519b
aaagugcauccuuuuagagguu

SEQ ID NO: 2251 - RNA, 22 nt, Artificial Sequence
  Synthetic construct: hsa-miR-519b
cucuagagggaagcgcuuucug

SEQ ID NO: 2252 - RNA, 22 nt, Artificial Sequence
  Synthetic construct: hsa-miR-519c
aaagugcaucuuuuuagaggau

SEQ ID NO: 2253 - RNA, 22 nt, Artificial Sequence
  Synthetic construct: hsa-miR-519c
cucuagagggaagcgcuuucug

SEQ ID NO: 2254 - RNA, 22 nt, Artificial Sequence
  Synthetic construct: hsa-miR-519d
caaagugccucccuuuagagug

SEQ ID NO: 2255 - RNA, 25 nt, Artificial Sequence
  Synthetic construct: hsa-miR-519d
ccuccaaagggaagcgcuuucuguu

SEQ ID NO: 2256 - RNA, 22 nt, Artificial Sequence
  Synthetic construct: hsa-miR-519e
uucuccaaaagggagcacuuuc

SEQ ID NO: 2257 - RNA, 22 nt, Artificial Sequence
  Synthetic construct: hsa-miR-519e
aagugccuccuuuuagaguguu

SEQ ID NO: 2258 - RNA, 22 nt, Artificial Sequence
  Synthetic construct: hsa-miR-520a
aaagugcuucccuuuggacugu

SEQ ID NO: 2259 - RNA, 21 nt, Artificial Sequence
  Synthetic construct: hsa-miR-520a
cuccagagggaaguacuuucu

SEQ ID NO: 2260 - RNA, 21 nt, Artificial Sequence
  Synthetic construct: hsa-miR-520b
aaagugcuuccuuuuagaggg

SEQ ID NO: 2261 - RNA, 21 nt, Artificial Sequence
  Synthetic construct: hsa-miR-520b
cucuaaaaggaagcacuuuuu

SEQ ID NO: 2262 - RNA, 22 nt, Artificial Sequence
  Synthetic construct: hsa-miR-520c
cucuagagggaagcacuuucug

SEQ ID NO: 2263 - RNA, 22 nt, Artificial Sequence
  Synthetic construct: hsa-miR-520c
aaagugcuuccuuuuagagggu

SEQ ID NO: 2264 - RNA, 20 nt, Artificial Sequence
  Synthetic construct: hsa-miR-520d
cuacaaagggaagcccuuuc

SEQ ID NO: 2265 - RNA, 22 nt, Artificial Sequence
  Synthetic construct: hsa-miR-520d
aaagugcuucucuuuggugggu

SEQ ID NO: 2266 - RNA, 21 nt, Artificial Sequence
  Synthetic construct: hsa-miR-520e
aaagugcuuccuuuuugaggg

SEQ ID NO: 2267 - RNA, 21 nt, Artificial Sequence
  Synthetic construct: hsa-miR-520e
cucaaaaaggaagcacuuuuu

SEQ ID NO: 2268 - RNA, 22 nt, Artificial Sequence
  Synthetic construct: hsa-miR-520f
ccucuaaagggaagcgcuuucu

SEQ ID NO: 2269 - RNA, 22 nt, Artificial Sequence
  Synthetic construct: hsa-miR-520f
aagugcuuccuuuuagaggguu

SEQ ID NO: 2270 - RNA, 23 nt, Artificial Sequence
  Synthetic construct: hsa-miR-520g
ucuagaggaagcacuuucuguuu

SEQ ID NO: 2271 - RNA, 24 nt, Artificial Sequence
  Synthetic construct: hsa-miR-520g
acaaagugcuucccuuuagagugu

SEQ ID NO: 2272 - RNA, 22 nt, Artificial Sequence
  Synthetic construct: hsa-miR-520h
acaaagugcuucccuuuagagu

SEQ ID NO: 2273 - RNA, 22 nt, Artificial Sequence
  Synthetic construct: hsa-miR-520h
ucuaaagggaagcacuuuguuu

SEQ ID NO: 2274 - RNA, 22 nt, Artificial Sequence
  Synthetic construct: hsa-miR-521
aacgcacuucccuuuagagugu

SEQ ID NO: 2275 - RNA, 22 nt, Artificial Sequence
  Synthetic construct: hsa-miR-521
acucuaaagggaagugcguuuu

SEQ ID NO: 2276 - RNA, 22 nt, Artificial Sequence
  Synthetic construct: hsa-miR-522
cucuagagggaagcgcuuucug

SEQ ID NO: 2277 - RNA, 22 nt, Artificial Sequence
  Synthetic construct: hsa-miR-522
aaaaugguucccuuuagagugu

SEQ ID NO: 2278 - RNA, 22 nt, Artificial Sequence
  Synthetic construct: hsa-miR-523
cucuagagggaagcgcuuucug

SEQ ID NO: 2279 - RNA, 23 nt, Artificial Sequence
  Synthetic construct: hsa-miR-523
gaacgcgcuucccuauagagggu

SEQ ID NO: 2280 - RNA, 21 nt, Artificial Sequence
  Synthetic construct: hsa-miR-524
gaaggcgcuucccuuuggagu

SEQ ID NO: 2281 - RNA, 22 nt, Artificial Sequence
  Synthetic construct: hsa-miR-524
cuacaaagggaagcacuuucuc

SEQ ID NO: 2282 - RNA, 21 nt, Artificial Sequence
  Synthetic construct: hsa-miR-525
cuccagagggaugcacuuucu

SEQ ID NO: 2283 - RNA, 22 nt, Artificial Sequence
  Synthetic construct: hsa-miR-525
gaaggcgcuucccuuuagagcg

SEQ ID NO: 2284 - RNA, 22 nt, Artificial Sequence
  Synthetic construct: hsa-miR-526a
cucuagagggaagcacuuucug

SEQ ID NO: 2285 - RNA, 22 nt, Artificial Sequence
  Synthetic construct: hsa-miR-526a
gaaagugcuucccucuagaguu

SEQ ID NO: 2286 - RNA, 22 nt, Artificial Sequence
  Synthetic construct: hsa-miR-526b
gaaagugcuuccuuuuagaggc

SEQ ID NO: 2287 - RNA, 23 nt, Artificial Sequence
  Synthetic construct: hsa-miR-526b
cucuugagggaagcacuuucugu

SEQ ID NO: 2288 - RNA, 20 nt, Artificial Sequence
  Synthetic construct: hsa-miR-527
cugcaaagggaagcccuuuc

SEQ ID NO: 2289 - RNA, 20 nt, Artificial Sequence
  Synthetic construct: hsa-miR-527
aagggcuucccuuugcaguu

SEQ ID NO: 2290 - RNA, 22 nt, Artificial Sequence
  Synthetic construct: hsa-miR-532
ccucccacacccaaggcuugca

SEQ ID NO: 2291 - RNA, 22 nt, Artificial Sequence
  Synthetic construct: hsa-miR-532
caugccuugaguguaggaccgu

SEQ ID NO: 2292 - RNA, 22 nt, Artificial Sequence
  Synthetic construct: hsa-miR-539
ggagaaauuauccuuggugugu

SEQ ID NO: 2293 - RNA, 22 nt, Artificial Sequence
  Synthetic construct: hsa-miR-539
aucauacaaggacaauuucuuu

SEQ ID NO: 2294 - RNA, 22 nt, Artificial Sequence
  Synthetic construct: hsa-miR-541
uggugggcacagaaucuggacu

SEQ ID NO: 2295 - RNA, 25 nt, Artificial Sequence
  Synthetic construct: hsa-miR-541
aaaggauucugcugucggucccacu

SEQ ID NO: 2296 - RNA, 22 nt, Artificial Sequence
  Synthetic construct: hsa-miR-542
ugugacagauugauaacugaaa

SEQ ID NO: 2297 - RNA, 23 nt, Artificial Sequence
  Synthetic construct: hsa-miR-542
ucggggaucaucaugucacgaga

SEQ ID NO: 2298 - RNA, 22 nt, Artificial Sequence
  Synthetic construct: hsa-miR-543
aaacauucgcggugcacuucuu

SEQ ID NO: 2299 - RNA, 22 nt, Artificial Sequence
  Synthetic construct: hsa-miR-543
gaagugcaccgcgaauguuuuu

SEQ ID NO: 2300 - RNA, 22 nt, Artificial Sequence
  Synthetic construct: hsa-miR-544a
auucugcauuuuuagcaaguuc

SEQ ID NO: 2301 - RNA, 22 nt, Artificial Sequence
  Synthetic construct: hsa-miR-544a
acuugcuaaaaaugcagaauuu

SEQ ID NO: 2302 - RNA, 22 nt, Artificial Sequence
  Synthetic construct: hsa-miR-544b
accugagguugugcauuucuaa

SEQ ID NO: 2303 - RNA, 22 nt, Artificial Sequence
  Synthetic construct: hsa-miR-544b
agaaaugcacaaccucagguuu

SEQ ID NO: 2304 - RNA, 22 nt, Artificial Sequence
  Synthetic construct: hsa-miR-545
ucaguaaauguuuauuagauga

SEQ ID NO: 2305 - RNA, 22 nt, Artificial Sequence
  Synthetic construct: hsa-miR-545
ucagcaaacauuuauugugugc

SEQ ID NO: 2306 - RNA, 22 nt, Artificial Sequence
  Synthetic construct: hsa-miR-548a
caaaacuggcaauuacuuuugc

SEQ ID NO: 2307 - RNA, 22 nt, Artificial Sequence
  Synthetic construct: hsa-miR-548a
aaaaguaauugcgaguuuuacc

SEQ ID NO: 2308 - RNA, 25 nt, Artificial Sequence
  Synthetic construct: hsa-miR-548aa
aaaaaccacaauuacuuuugcacca

SEQ ID NO: 2309 - RNA, 25 nt, Artificial Sequence
  Synthetic construct: hsa-miR-548aa
gugcaaaaguaauugugguuuuuuu

SEQ ID NO: 2310 - RNA, 22 nt, Artificial Sequence
  Synthetic construct: hsa-miR-548ab
aaaaguaauuguggauuuugcu

SEQ ID NO: 2311 - RNA, 22 nt, Artificial Sequence
  Synthetic construct: hsa-miR-548ab
caaaauccacaauuacuuuuuu

SEQ ID NO: 2312 - RNA, 22 nt, Artificial Sequence
  Synthetic construct: hsa-miR-548ac
caaaaaccggcaauuacuuuug

SEQ ID NO: 2313 - RNA, 22 nt, Artificial Sequence
  Synthetic construct: hsa-miR-548ac
aaaguaauugccgguuuuuguu

SEQ ID NO: 2314 - RNA, 20 nt, Artificial Sequence
  Synthetic construct: hsa-miR-548ad
aaaaguaauugugguuuuug

SEQ ID NO: 2315 - RNA, 22 nt, Artificial Sequence
  Synthetic construct: hsa-miR-548ad
gaaaacgacaaugacuuuugca

SEQ ID NO: 2316 - RNA, 21 nt, Artificial Sequence
  Synthetic construct: hsa-miR-548ae
caaaaacugcaauuacuuuca

SEQ ID NO: 2317 - RNA, 20 nt, Artificial Sequence
  Synthetic construct: hsa-miR-548ae
aaaaguaauugugguuuuug

SEQ ID NO: 2318 - RNA, 21 nt, Artificial Sequence
  Synthetic construct: hsa-miR-548ag
aaagguaauugugguuucugc

SEQ ID NO: 2319 - RNA, 21 nt, Artificial Sequence
  Synthetic construct: hsa-miR-548ag
agaaaccacaauuaccuuuuu

SEQ ID NO: 2320 - RNA, 22 nt, Artificial Sequence
  Synthetic construct: hsa-miR-548ah
caaaaacugcaguuacuuuugc

SEQ ID NO: 2321 - RNA, 20 nt, Artificial Sequence
  Synthetic construct: hsa-miR-548ah
aaaagugauugcaguguuug

SEQ ID NO: 2322 - RNA, 22 nt, Artificial Sequence
  Synthetic construct: hsa-miR-548ai
aaagguaauugcaguuuuuccc

SEQ ID NO: 2323 - RNA, 22 nt, Artificial Sequence
  Synthetic construct: hsa-miR-548ai
gaaaaacugcaauuaccuuuuu

SEQ ID NO: 2324 - RNA, 23 nt, Artificial Sequence
  Synthetic construct: hsa-miR-548aj
ugcaaaaguaauugcaguuuuug

SEQ ID NO: 2325 - RNA, 21 nt, Artificial Sequence
  Synthetic construct: hsa-miR-548aj
uaaaaacugcaauuacuuuua

SEQ ID NO: 2326 - RNA, 21 nt, Artificial Sequence
  Synthetic construct: hsa-miR-548ak
aaaaguaacugcgguuuuuga

SEQ ID NO: 2327 - RNA, 21 nt, Artificial Sequence
  Synthetic construct: hsa-miR-548ak
aaaaaccgcaguuacuuuuuu

SEQ ID NO: 2328 - RNA, 22 nt, Artificial Sequence
  Synthetic construct: hsa-miR-548al
aacggcaaugacuuuuguacca

SEQ ID NO: 2329 - RNA, 22 nt, Artificial Sequence
  Synthetic construct: hsa-miR-548al
guacaaaagucauugccguuuu

SEQ ID NO: 2330 - RNA, 22 nt, Artificial Sequence
  Synthetic construct: hsa-miR-548am
aaaaguaauugcgguuuuugcc

SEQ ID NO: 2331 - RNA, 22 nt, Artificial Sequence
  Synthetic construct: hsa-miR-548am
caaaaacugcaguuacuuuugu

SEQ ID NO: 2332 - RNA, 20 nt, Artificial Sequence
  Synthetic construct: hsa-miR-548an
aaaaggcauugugguuuuug

SEQ ID NO: 2333 - RNA, 20 nt, Artificial Sequence
  Synthetic construct: hsa-miR-548an
aaaaccacaaugccuuuuuu

SEQ ID NO: 2334 - RNA, 22 nt, Artificial Sequence
  Synthetic construct: hsa-miR-548ao
agaaguaacuacgguuuuugca

SEQ ID NO: 2335 - RNA, 22 nt, Artificial Sequence
  Synthetic construct: hsa-miR-548ao
aaagaccgugacuacuuuugca

SEQ ID NO: 2336 - RNA, 19 nt, Artificial Sequence
  Synthetic construct: hsa-miR-548ap
aaaaguaauugcggucuuu

SEQ ID NO: 2337 - RNA, 19 nt, Artificial Sequence
  Synthetic construct: hsa-miR-548ap
aaaaaccacaauuacuuuu

SEQ ID NO: 2338 - RNA, 22 nt, Artificial Sequence
  Synthetic construct: hsa-miR-548aq
gaaaguaauugcuguuuuugcc

SEQ ID NO: 2339 - RNA, 22 nt, Artificial Sequence
  Synthetic construct: hsa-miR-548aq
caaaaacugcaauuacuuuugc

SEQ ID NO: 2340 - RNA, 21 nt, Artificial Sequence
  Synthetic construct: hsa-miR-548ar
aaaaguaauugcaguuuuugc

SEQ ID NO: 2341 - RNA, 21 nt, Artificial Sequence
  Synthetic construct: hsa-miR-548ar
uaaaacugcaguuauuuuugc

SEQ ID NO: 2342 - RNA, 22 nt, Artificial Sequence
  Synthetic construct: hsa-miR-548as
uaaaacccacaauuauguuugu

SEQ ID NO: 2343 - RNA, 22 nt, Artificial Sequence
  Synthetic construct: hsa-miR-548as
aaaaguaauugcggguuuugcc

SEQ ID NO: 2344 - RNA, 22 nt, Artificial Sequence
  Synthetic construct: hsa-miR-548at
aaaaguuauugcgguuuuggcu

SEQ ID NO: 2345 - RNA, 21 nt, Artificial Sequence
  Synthetic construct: hsa-miR-548at
caaaaccgcaguaacuuuugu

SEQ ID NO: 2346 - RNA, 21 nt, Artificial Sequence
  Synthetic construct: hsa-miR-548au
uggcaguuacuuuugcaccag

SEQ ID NO: 2347 - RNA, 21 nt, Artificial Sequence
  Synthetic construct: hsa-miR-548au
aaaaguaauugcgguuuuugc

SEQ ID NO: 2348 - RNA, 20 nt, Artificial Sequence
  Synthetic construct: hsa-miR-548av
aaaacugcaguuacuuuugc

SEQ ID NO: 2349 - RNA, 18 nt, Artificial Sequence
  Synthetic construct: hsa-miR-548av
aaaaguacuugcggauuu

SEQ ID NO: 2350 - RNA, 20 nt, Artificial Sequence
  Synthetic construct: hsa-miR-548aw
gugcaaaagucaucacgguu

SEQ ID NO: 2351 - RNA, 20 nt, Artificial Sequence
  Synthetic construct: hsa-miR-548aw
ccgugaugacuuuugcacuu

SEQ ID NO: 2352 - RNA, 22 nt, Artificial Sequence
  Synthetic construct: hsa-miR-548ax
agaaguaauugcgguuuugcca

SEQ ID NO: 2353 - RNA, 22 nt, Artificial Sequence
  Synthetic construct: hsa-miR-548ax
gcaaaaccgcaauuacuucuuu

SEQ ID NO: 2354 - RNA, 22 nt, Artificial Sequence
  Synthetic construct: hsa-miR-548ay
caaaaccgcgauuacucuugca

SEQ ID NO: 2355 - RNA, 21 nt, Artificial Sequence
  Synthetic construct: hsa-miR-548ay
aaaaguaauugugguuuuugc

SEQ ID NO: 2356 - RNA, 21 nt, Artificial Sequence
  Synthetic construct: hsa-miR-548az
aaaaacugcaaucacuuuugc

SEQ ID NO: 2357 - RNA, 22 nt, Artificial Sequence
  Synthetic construct: hsa-miR-548az
caaaagugauugugguuuuugc

SEQ ID NO: 2358 - RNA, 22 nt, Artificial Sequence
  Synthetic construct: hsa-miR-548b
aaaaguaauugugguuuuggcc

SEQ ID NO: 2359 - RNA, 22 nt, Artificial Sequence
  Synthetic construct: hsa-miR-548b
caagaaccucaguugcuuuugu

SEQ ID NO: 2360 - RNA, 22 nt, Artificial Sequence
  Synthetic construct: hsa-miR-548ba
aaagguaacugugauuuuugcu

SEQ ID NO: 2361 - RNA, 22 nt, Artificial Sequence
  Synthetic construct: hsa-miR-548ba
caaaaaucacaguuaccuuuuu

SEQ ID NO: 2362 - RNA, 22 nt, Artificial Sequence
  Synthetic construct: hsa-miR-548bb
aaaaguaacuaugguuuuugcc

SEQ ID NO: 2363 - RNA, 22 nt, Artificial Sequence
  Synthetic construct: hsa-miR-548bb
caaaaaccauaguuacuuuugc

SEQ ID NO: 2364 - RNA, 22 nt, Artificial Sequence
  Synthetic construct: hsa-miR-548c
aaaaguaauugcgguuuuugcc

SEQ ID NO: 2365 - RNA, 22 nt, Artificial Sequence
  Synthetic construct: hsa-miR-548c
caaaaaucucaauuacuuuugc

SEQ ID NO: 2366 - RNA, 22 nt, Artificial Sequence
  Synthetic construct: hsa-miR-548d
caaaaaccacaguuucuuuugc

SEQ ID NO: 2367 - RNA, 22 nt, Artificial Sequence
  Synthetic construct: hsa-miR-548d
aaaaguaauugugguuuuugcc

SEQ ID NO: 2368 - RNA, 22 nt, Artificial Sequence
  Synthetic construct: hsa-miR-548e
aaaaacugagacuacuuuugca

SEQ ID NO: 2369 - RNA, 22 nt, Artificial Sequence
  Synthetic construct: hsa-miR-548e
caaaagcaaucgcgguuuuugc

SEQ ID NO: 2370 - RNA, 19 nt, Artificial Sequence
  Synthetic construct: hsa-miR-548f
aaaaacuguaauuacuuuu

SEQ ID NO: 2371 - RNA, 22 nt, Artificial Sequence
  Synthetic construct: hsa-miR-548f
ugcaaaaguaaucacaguuuuu

SEQ ID NO: 2372 - RNA, 23 nt, Artificial Sequence
  Synthetic construct: hsa-miR-548g
ugcaaaaguaauugcaguuuuug

SEQ ID NO: 2373 - RNA, 22 nt, Artificial Sequence
  Synthetic construct: hsa-miR-548g
aaaacuguaauuacuuuuguac

SEQ ID NO: 2374 - RNA, 23 nt, Artificial Sequence
  Synthetic construct: hsa-miR-548h
caaaaaccgcaauuacuuuugca

SEQ ID NO: 2375 - RNA, 22 nt, Artificial Sequence
  Synthetic construct: hsa-miR-548h
aaaaguaaucgcgguuuuuguc

SEQ ID NO: 2376 - RNA, 22 nt, Artificial Sequence
  Synthetic construct: hsa-miR-548i
aaaaguaauugcggauuuugcc

SEQ ID NO: 2377 - RNA, 22 nt, Artificial Sequence
  Synthetic construct: hsa-miR-548i
caaaauccgcaauuacuuuuuu

SEQ ID NO: 2378 - RNA, 21 nt, Artificial Sequence
  Synthetic construct: hsa-miR-548j
caaaaacugcauuacuuuugc

SEQ ID NO: 2379 - RNA, 22 nt, Artificial Sequence
  Synthetic construct: hsa-miR-548j
aaaaguaauugcggucuuuggu

SEQ ID NO: 2380 - RNA, 22 nt, Artificial Sequence
  Synthetic construct: hsa-miR-548k
aaaaguacuugcggauuuugcu

SEQ ID NO: 2381 - RNA, 22 nt, Artificial Sequence
  Synthetic construct: hsa-miR-548k
caaaauccgcaaguacuuuuuu

SEQ ID NO: 2382 - RNA, 22 nt, Artificial Sequence
  Synthetic construct: hsa-miR-548l
aaaaguauuugcggguuuuguc

SEQ ID NO: 2383 - RNA, 22 nt, Artificial Sequence
  Synthetic construct: hsa-miR-548l
caaaacccgcaaauacuuuuuu

SEQ ID NO: 2384 - RNA, 21 nt, Artificial Sequence
  Synthetic construct: hsa-miR-548m
caaagguauuugugguuuuug

SEQ ID NO: 2385 - RNA, 21 nt, Artificial Sequence
  Synthetic construct: hsa-miR-548m
aaaaccacaaauaccuuuguu

SEQ ID NO: 2386 - RNA, 22 nt, Artificial Sequence
  Synthetic construct: hsa-miR-548n
caaaaguaauuguggauuuugu

SEQ ID NO: 2387 - RNA, 22 nt, Artificial Sequence
  Synthetic construct: hsa-miR-548n
aaaauccacaauuacuuuuguu

SEQ ID NO: 2388 - RNA, 22 nt, Artificial Sequence
  Synthetic construct: hsa-miR-548o
ccaaaacugcaguuacuuuugc

SEQ ID NO: 2389 - RNA, 22 nt, Artificial Sequence
  Synthetic construct: hsa-miR-548o
aaaaguaauugcgguuuuugcc

SEQ ID NO: 2390 - RNA, 22 nt, Artificial Sequence
  Synthetic construct: hsa-miR-548p
uagcaaaaacugcaguuacuuu

SEQ ID NO: 2391 - RNA, 22 nt, Artificial Sequence
  Synthetic construct: hsa-miR-548p
aguaacugcaguuuuugcuauu

SEQ ID NO: 2392 - RNA, 22 nt, Artificial Sequence
  Synthetic construct: hsa-miR-548q
gcuggugcaaaaguaauggcgg

SEQ ID NO: 2393 - RNA, 22 nt, Artificial Sequence
  Synthetic construct: hsa-miR-548q
gccauuacuuuugcaccagcuu

SEQ ID NO: 2394 - RNA, 23 nt, Artificial Sequence
  Synthetic construct: hsa-miR-548s
auggccaaaacugcaguuauuuu

SEQ ID NO: 2395 - RNA, 23 nt, Artificial Sequence
  Synthetic construct: hsa-miR-548s
aauaacugcaguuuuggccauuu

SEQ ID NO: 2396 - RNA, 25 nt, Artificial Sequence
  Synthetic construct: hsa-miR-548t
aaaaaccacaauuacuuuugcacca

SEQ ID NO: 2397 - RNA, 21 nt, Artificial Sequence
  Synthetic construct: hsa-miR-548t
caaaagugaucgugguuuuug

SEQ ID NO: 2398 - RNA, 23 nt, Artificial Sequence
  Synthetic construct: hsa-miR-548u
caaagacugcaauuacuuuugcg

SEQ ID NO: 2399 - RNA, 23 nt, Artificial Sequence
  Synthetic construct: hsa-miR-548u
caaaaguaauugcagucuuuguu

SEQ ID NO: 2400 - RNA, 22 nt, Artificial Sequence
  Synthetic construct: hsa-miR-548v
agcuacaguuacuuuugcacca

SEQ ID NO: 2401 - RNA, 22 nt, Artificial Sequence
  Synthetic construct: hsa-miR-548v
gugcaaaaguaacuguagcuuu

SEQ ID NO: 2402 - RNA, 23 nt, Artificial Sequence
  Synthetic construct: hsa-miR-548w
aaaaguaacugcgguuuuugccu

SEQ ID NO: 2403 - RNA, 23 nt, Artificial Sequence
  Synthetic construct: hsa-miR-548w
gcaaaaaccgcaguuacuuuuuu

SEQ ID NO: 2404 - RNA, 23 nt, Artificial Sequence
  Synthetic construct: hsa-miR-548x
ugcaaaaguaauugcaguuuuug

SEQ ID NO: 2405 - RNA, 20 nt, Artificial Sequence
  Synthetic construct: hsa-miR-548x
uaaaaacugcaauuacuuuc

SEQ ID NO: 2406 - RNA, 22 nt, Artificial Sequence
  Synthetic construct: hsa-miR-548y
aaaaguaaucacuguuuuugcc

SEQ ID NO: 2407 - RNA, 22 nt, Artificial Sequence
  Synthetic construct: hsa-miR-548y
caaaaacagugauuacuuuuuu

SEQ ID NO: 2408 - RNA, 23 nt, Artificial Sequence
  Synthetic construct: hsa-miR-548z
caaaaaccgcaauuacuuuugca

SEQ ID NO: 2409 - RNA, 23 nt, Artificial Sequence
  Synthetic construct: hsa-miR-548z
caaaaguaauugcgguuuuuguu

SEQ ID NO: 2410 - RNA, 21 nt, Artificial Sequence
  Synthetic construct: hsa-miR-549a
ugacaacuauggaugagcucu

SEQ ID NO: 2411 - RNA, 21 nt, Artificial Sequence
  Synthetic construct: hsa-miR-549a
agcucauccauaguugucauu

SEQ ID NO: 2412 - RNA, 22 nt, Artificial Sequence
  Synthetic construct: hsa-miR-550a-1
ugucuuacucccucaggcacau

SEQ ID NO: 2413 - RNA, 23 nt, Artificial Sequence
  Synthetic construct: hsa-miR-550a-1
agugccugagggaguaagagccc

SEQ ID NO: 2414 - RNA, 22 nt, Artificial Sequence
  Synthetic construct: hsa-miR-550a-3
ugucuuacucccucaggcacau

SEQ ID NO: 2415 - RNA, 20 nt, Artificial Sequence
  Synthetic construct: hsa-miR-550a-3
agugccugagggaguaagag

SEQ ID NO: 2416 - RNA, 20 nt, Artificial Sequence
  Synthetic construct: hsa-miR-550b
ucuuacucccucaggcacug

SEQ ID NO: 2417 - RNA, 22 nt, Artificial Sequence
  Synthetic construct: hsa-miR-550b
augugccugagggaguaagaca

SEQ ID NO: 2418 - RNA, 21 nt, Artificial Sequence
  Synthetic construct: hsa-miR-551a
gcgacccacucuugguuucca

SEQ ID NO: 2419 - RNA, 21 nt, Artificial Sequence
  Synthetic construct: hsa-miR-551a
gaaaccaagagugggucgcuu

SEQ ID NO: 2420 - RNA, 22 nt, Artificial Sequence
  Synthetic construct: hsa-miR-551b
gaaaucaagcgugggugagacc

SEQ ID NO: 2421 - RNA, 21 nt, Artificial Sequence
  Synthetic construct: hsa-miR-551b
gcgacccauacuugguuucag

SEQ ID NO: 2422 - RNA, 21 nt, Artificial Sequence
  Synthetic construct: hsa-miR-552
guuuaaccuuuugccuguugg

SEQ ID NO: 2423 - RNA, 21 nt, Artificial Sequence
  Synthetic construct: hsa-miR-552
aacaggugacugguuagacaa

SEQ ID NO: 2424 - RNA, 21 nt, Artificial Sequence
  Synthetic construct: hsa-miR-553
aaaacggugagauuuuguuuu

SEQ ID NO: 2425 - RNA, 21 nt, Artificial Sequence
  Synthetic construct: hsa-miR-553
aacaaaaucucaccguuuuuu

SEQ ID NO: 2426 - RNA, 21 nt, Artificial Sequence
  Synthetic construct: hsa-miR-554
gcuaguccugacucagccagu

SEQ ID NO: 2427 - RNA, 21 nt, Artificial Sequence
  Synthetic construct: hsa-miR-554
uggcugagucaggacuagcuu

SEQ ID NO: 2428 - RNA, 21 nt, Artificial Sequence
  Synthetic construct: hsa-miR-555
aggguaagcugaaccucugau

SEQ ID NO: 2429 - RNA, 21 nt, Artificial Sequence
  Synthetic construct: hsa-miR-555
cagagguucagcuuacccuuu

SEQ ID NO: 2430 - RNA, 22 nt, Artificial Sequence
  Synthetic construct: hsa-miR-556
gaugagcucauuguaauaugag

SEQ ID NO: 2431 - RNA, 22 nt, Artificial Sequence
  Synthetic construct: hsa-miR-556
auauuaccauuagcucaucuuu

SEQ ID NO: 2432 - RNA, 23 nt, Artificial Sequence
  Synthetic construct: hsa-miR-557
guuugcacgggugggccuugucu

SEQ ID NO: 2433 - RNA, 23 nt, Artificial Sequence
  Synthetic construct: hsa-miR-557
acaaggcccacccgugcaaacuu

SEQ ID NO: 2434 - RNA, 19 nt, Artificial Sequence
  Synthetic construct: hsa-miR-5571
guccuaggaggcuccucug

SEQ ID NO: 2435 - RNA, 21 nt, Artificial Sequence
  Synthetic construct: hsa-miR-5571
caauucucaaaggagccuccc

SEQ ID NO: 2436 - RNA, 21 nt, Artificial Sequence
  Synthetic construct: hsa-miR-5572
guuggggugcaggggucugcu

SEQ ID NO: 2437 - RNA, 21 nt, Artificial Sequence
  Synthetic construct: hsa-miR-5572
cagaccccugcaccccaacuu

SEQ ID NO: 2438 - RNA, 21 nt, Artificial Sequence
  Synthetic construct: hsa-miR-5579
uaugguacuccuuaagcuaac

SEQ ID NO: 2439 - RNA, 22 nt, Artificial Sequence
  Synthetic construct: hsa-miR-5579
uuagcuuaaggaguaccagauc

SEQ ID NO: 2440 - RNA, 19 nt, Artificial Sequence
  Synthetic construct: hsa-miR-558
ugagcugcuguaccaaaau

SEQ ID NO: 2441 - RNA, 19 nt, Artificial Sequence
  Synthetic construct: hsa-miR-558
uuugguacagcagcucauu

SEQ ID NO: 2442 - RNA, 22 nt, Artificial Sequence
  Synthetic construct: hsa-miR-5580
cacauaugaagugagccagcac

SEQ ID NO: 2443 - RNA, 22 nt, Artificial Sequence
  Synthetic construct: hsa-miR-5580
ugcuggcucauuucauaugugu

SEQ ID NO: 2444 - RNA, 22 nt, Artificial Sequence
  Synthetic construct: hsa-miR-5581
agccuuccaggagaaauggaga

SEQ ID NO: 2445 - RNA, 22 nt, Artificial Sequence
  Synthetic construct: hsa-miR-5581
uuccaugccuccuagaaguucc

SEQ ID NO: 2446 - RNA, 22 nt, Artificial Sequence
  Synthetic construct: hsa-miR-5582
uaaaacuuuaagugugccuagg

SEQ ID NO: 2447 - RNA, 22 nt, Artificial Sequence
  Synthetic construct: hsa-miR-5582
uaggcacacuuaaaguuauagc

SEQ ID NO: 2448 - RNA, 22 nt, Artificial Sequence
  Synthetic construct: hsa-miR-5583
gaauauggguauauuaguuugg

SEQ ID NO: 2449 - RNA, 22 nt, Artificial Sequence
  Synthetic construct: hsa-miR-5583
aaacuaauauacccauauucug

SEQ ID NO: 2450 - RNA, 22 nt, Artificial Sequence
  Synthetic construct: hsa-miR-5584
cagggaaaugggaagaacuaga

SEQ ID NO: 2451 - RNA, 22 nt, Artificial Sequence
  Synthetic construct: hsa-miR-5584
uaguucuucccuuugcccaauu

SEQ ID NO: 2452 - RNA, 22 nt, Artificial Sequence
  Synthetic construct: hsa-miR-5585
cugaauagcugggacuacaggu

SEQ ID NO: 2453 - RNA, 22 nt, Artificial Sequence
  Synthetic construct: hsa-miR-5585
ugaaguaccagcuacucgagag

SEQ ID NO: 2454 - RNA, 22 nt, Artificial Sequence
  Synthetic construct: hsa-miR-5586
uauccagcuuguuacuauaugc

SEQ ID NO: 2455 - RNA, 22 nt, Artificial Sequence
  Synthetic construct: hsa-miR-5586
cagagugacaagcugguuaaag

SEQ ID NO: 2456 - RNA, 18 nt, Artificial Sequence
  Synthetic construct: hsa-miR-5587
auggucaccuccgggacu

SEQ ID NO: 2457 - RNA, 21 nt, Artificial Sequence
  Synthetic construct: hsa-miR-5587
gccccgggcagugugaucauc

SEQ ID NO: 2458 - RNA, 21 nt, Artificial Sequence
  Synthetic construct: hsa-miR-5588
acuggcauuagugggacuuuu

SEQ ID NO: 2459 - RNA, 19 nt, Artificial Sequence
  Synthetic construct: hsa-miR-5588
aagucccacuaaugccagc

SEQ ID NO: 2460 - RNA, 21 nt, Artificial Sequence
  Synthetic construct: hsa-miR-5589
ggcugggugcucuugugcagu

SEQ ID NO: 2461 - RNA, 23 nt, Artificial Sequence
  Synthetic construct: hsa-miR-5589
ugcacauggcaaccuagcuccca

SEQ ID NO: 2462 - RNA, 21 nt, Artificial Sequence
  Synthetic construct: hsa-miR-559
uaaaguaaauaugcaccaaaa

SEQ ID NO: 2463 - RNA, 21 nt, Artificial Sequence
  Synthetic construct: hsa-miR-559
uuggugcauauuuacuuuauu

SEQ ID NO: 2464 - RNA, 21 nt, Artificial Sequence
  Synthetic construct: hsa-miR-5590
aauaaaguucauguauggcaa

SEQ ID NO: 2465 - RNA, 21 nt, Artificial Sequence
  Synthetic construct: hsa-miR-5590
uugccauacauagacuuuauu

SEQ ID NO: 2466 - RNA, 21 nt, Artificial Sequence
  Synthetic construct: hsa-miR-5591
ugggagcuaagcuauggguau

SEQ ID NO: 2467 - RNA, 21 nt, Artificial Sequence
  Synthetic construct: hsa-miR-5591
auacccauagcuuagcuccca

SEQ ID NO: 2468 - RNA, 22 nt, Artificial Sequence
  Synthetic construct: hsa-miR-561
caaaguuuaagauccuugaagu

SEQ ID NO: 2469 - RNA, 22 nt, Artificial Sequence
  Synthetic construct: hsa-miR-561
aucaaggaucuuaaacuuugcc

SEQ ID NO: 2470 - RNA, 20 nt, Artificial Sequence
  Synthetic construct: hsa-miR-562
aaaguagcuguaccauuugc

SEQ ID NO: 2471 - RNA, 20 nt, Artificial Sequence
  Synthetic construct: hsa-miR-562
aaaugguacagcuacuuuuu

SEQ ID NO: 2472 - RNA, 19 nt, Artificial Sequence
  Synthetic construct: hsa-miR-563
agguugacauacguuuccc

SEQ ID NO: 2473 - RNA, 19 nt, Artificial Sequence
  Synthetic construct: hsa-miR-563
gaaacguaugucaaccuuu

SEQ ID NO: 2474 - RNA, 19 nt, Artificial Sequence
  Synthetic construct: hsa-miR-564
aggcacggugucagcaggc

SEQ ID NO: 2475 - RNA, 19 nt, Artificial Sequence
  Synthetic construct: hsa-miR-564
cugcugacaccgugccuuu

SEQ ID NO: 2476 - RNA, 19 nt, Artificial Sequence
  Synthetic construct: hsa-miR-566
gggcgccugugaucccaac

SEQ ID NO: 2477 - RNA, 19 nt, Artificial Sequence
  Synthetic construct: hsa-miR-566
ugggaucacaggcgcccuu

SEQ ID NO: 2478 - RNA, 23 nt, Artificial Sequence
  Synthetic construct: hsa-miR-567
aguauguucuuccaggacagaac

SEQ ID NO: 2479 - RNA, 23 nt, Artificial Sequence
  Synthetic construct: hsa-miR-567
ucuguccuggaagaacauacuuu

SEQ ID NO: 2480 - RNA, 20 nt, Artificial Sequence
  Synthetic construct: hsa-miR-568
auguauaaauguauacacac

SEQ ID NO: 2481 - RNA, 20 nt, Artificial Sequence
  Synthetic construct: hsa-miR-568
guguauacauuuauacauuu

SEQ ID NO: 2482 - RNA, 22 nt, Artificial Sequence
  Synthetic construct: hsa-miR-5680
gagaaaugcuggacuaaucugc

SEQ ID NO: 2483 - RNA, 22 nt, Artificial Sequence
  Synthetic construct: hsa-miR-5680
agauuaguccagcauuucucuu

SEQ ID NO: 2484 - RNA, 22 nt, Artificial Sequence
  Synthetic construct: hsa-miR-5681a
agaaaggguggcaauaccucuu

SEQ ID NO: 2485 - RNA, 22 nt, Artificial Sequence
  Synthetic construct: hsa-miR-5681a
gagguauugccacccuuucuuu

SEQ ID NO: 2486 - RNA, 22 nt, Artificial Sequence
  Synthetic construct: hsa-miR-5681b
agguauugccacccuuucuagu

SEQ ID NO: 2487 - RNA, 22 nt, Artificial Sequence
  Synthetic construct: hsa-miR-5681b
uagaaaggguggcaauaccuuu

SEQ ID NO: 2488 - RNA, 22 nt, Artificial Sequence
  Synthetic construct: hsa-miR-5682
guagcaccuugcaggauaaggu

SEQ ID NO: 2489 - RNA, 22 nt, Artificial Sequence
  Synthetic construct: hsa-miR-5682
cuuauccugcaaggugcuacuu

SEQ ID NO: 2490 - RNA, 24 nt, Artificial Sequence
  Synthetic construct: hsa-miR-5683
uacagaugcagauucucugacuuc

SEQ ID NO: 2491 - RNA, 24 nt, Artificial Sequence
  Synthetic construct: hsa-miR-5683
agucagagaaucugcaucuguauu

SEQ ID NO: 2492 - RNA, 20 nt, Artificial Sequence
  Synthetic construct: hsa-miR-5684
aacucuagccugagcaacag

SEQ ID NO: 2493 - RNA, 20 nt, Artificial Sequence
  Synthetic construct: hsa-miR-5684
guugcucaggcuagaguuuu

SEQ ID NO: 2494 - RNA, 22 nt, Artificial Sequence
  Synthetic construct: hsa-miR-5685
acagcccagcaguuaucacggg

SEQ ID NO: 2495 - RNA, 22 nt, Artificial Sequence
  Synthetic construct: hsa-miR-5685
cgugauaacugcugggcuguuu

SEQ ID NO: 2496 - RNA, 22 nt, Artificial Sequence
  Synthetic construct: hsa-miR-5687
uuagaacguuuuagggucaaau

SEQ ID NO: 2497 - RNA, 22 nt, Artificial Sequence
  Synthetic construct: hsa-miR-5687
uugacccuaaaacguucuaauu

SEQ ID NO: 2498 - RNA, 22 nt, Artificial Sequence
  Synthetic construct: hsa-miR-5688
uaacaaacaccuguaaaacagc

SEQ ID NO: 2499 - RNA, 22 nt, Artificial Sequence
  Synthetic construct: hsa-miR-5688
uguuuuacagguguuuguuauu

SEQ ID NO: 2500 - RNA, 22 nt, Artificial Sequence
  Synthetic construct: hsa-miR-5689
agcauacaccuguaguccuaga

SEQ ID NO: 2501 - RNA, 22 nt, Artificial Sequence
  Synthetic construct: hsa-miR-5689
uaggacuacagguguaugcuuu

SEQ ID NO: 2502 - RNA, 21 nt, Artificial Sequence
  Synthetic construct: hsa-miR-569
aguuaaugaauccuggaaagu

SEQ ID NO: 2503 - RNA, 21 nt, Artificial Sequence
  Synthetic construct: hsa-miR-569
uuuccaggauucauuaacuuu

SEQ ID NO: 2504 - RNA, 21 nt, Artificial Sequence
  Synthetic construct: hsa-miR-5690
ucagcuacuaccucuauuagg

SEQ ID NO: 2505 - RNA, 21 nt, Artificial Sequence
  Synthetic construct: hsa-miR-5690
uaauagagguaguagcugauu

SEQ ID NO: 2506 - RNA, 22 nt, Artificial Sequence
  Synthetic construct: hsa-miR-5691
uugcucugagcuccgagaaagc

SEQ ID NO: 2507 - RNA, 22 nt, Artificial Sequence
  Synthetic construct: hsa-miR-5691
uuucucggagcucagagcaauu

SEQ ID NO: 2508 - RNA, 22 nt, Artificial Sequence
  Synthetic construct: hsa-miR-5692a
caaauaauaccacagugggugu

SEQ ID NO: 2509 - RNA, 22 nt, Artificial Sequence
  Synthetic construct: hsa-miR-5692a
acccacugugguauuauuuguu

SEQ ID NO: 2510 - RNA, 20 nt, Artificial Sequence
  Synthetic construct: hsa-miR-5692b
aauaauaucacaguaggugu

SEQ ID NO: 2511 - RNA, 20 nt, Artificial Sequence
  Synthetic construct: hsa-miR-5692b
accuacugugauauuauuuu

SEQ ID NO: 2512 - RNA, 22 nt, Artificial Sequence
  Synthetic construct: hsa-miR-5692c
aauaauaucacaguagguguac

SEQ ID NO: 2513 - RNA, 22 nt, Artificial Sequence
  Synthetic construct: hsa-miR-5692c
acaccuacugugauauuauuuu

SEQ ID NO: 2514 - RNA, 22 nt, Artificial Sequence
  Synthetic construct: hsa-miR-5693
gcaguggcucugaaaugaacuc

SEQ ID NO: 2515 - RNA, 22 nt, Artificial Sequence
  Synthetic construct: hsa-miR-5693
guucauuucagagccacugcuu

SEQ ID NO: 2516 - RNA, 21 nt, Artificial Sequence
  Synthetic construct: hsa-miR-5694
cagaucaugggacugucucag

SEQ ID NO: 2517 - RNA, 21 nt, Artificial Sequence
  Synthetic construct: hsa-miR-5694
gagacagucccaugaucuguu

SEQ ID NO: 2518 - RNA, 22 nt, Artificial Sequence
  Synthetic construct: hsa-miR-5695
acuccaagaagaaucuagacag

SEQ ID NO: 2519 - RNA, 22 nt, Artificial Sequence
  Synthetic construct: hsa-miR-5695
gucuagauucuucuuggaguuu

SEQ ID NO: 2520 - RNA, 22 nt, Artificial Sequence
  Synthetic construct: hsa-miR-5696
cucauuuaaguagucugaugcc

SEQ ID NO: 2521 - RNA, 22 nt, Artificial Sequence
  Synthetic construct: hsa-miR-5696
caucagacuacuuaaaugaguu

SEQ ID NO: 2522 - RNA, 22 nt, Artificial Sequence
  Synthetic construct: hsa-miR-5697
ucaaguaguuucaugauaaagg

SEQ ID NO: 2523 - RNA, 22 nt, Artificial Sequence
  Synthetic construct: hsa-miR-5697
uuuaucaugaaacuacuugauu

SEQ ID NO: 2524 - RNA, 22 nt, Artificial Sequence
  Synthetic construct: hsa-miR-5698
ugggggagugcagugauugugg

SEQ ID NO: 2525 - RNA, 22 nt, Artificial Sequence
  Synthetic construct: hsa-miR-5698
acaaucacugcacucccccauu

SEQ ID NO: 2526 - RNA, 22 nt, Artificial Sequence
  Synthetic construct: hsa-miR-5699
uccugucuuuccuuguuggagc

SEQ ID NO: 2527 - RNA, 22 nt, Artificial Sequence
  Synthetic construct: hsa-miR-5699
ugccccaacaaggaaggacaag

SEQ ID NO: 2528 - RNA, 22 nt, Artificial Sequence
  Synthetic construct: hsa-miR-570
cgaaaacagcaauuaccuuugc

SEQ ID NO: 2529 - RNA, 22 nt, Artificial Sequence
  Synthetic construct: hsa-miR-570
aaagguaauugcaguuuuuccc

SEQ ID NO: 2530 - RNA, 22 nt, Artificial Sequence
  Synthetic construct: hsa-miR-5700
uaaugcauuaaauuauugaagg

SEQ ID NO: 2531 - RNA, 22 nt, Artificial Sequence
  Synthetic construct: hsa-miR-5700
uucaauaauuuaaugcauuauu

SEQ ID NO: 2532 - RNA, 19 nt, Artificial Sequence
  Synthetic construct: hsa-miR-5701
uuauugucacguucugauu

SEQ ID NO: 2533 - RNA, 19 nt, Artificial Sequence
  Synthetic construct: hsa-miR-5701
ucagaacgugacaauaauu

SEQ ID NO: 2534 - RNA, 22 nt, Artificial Sequence
  Synthetic construct: hsa-miR-5702
ugagucagcaacauaucccaug

SEQ ID NO: 2535 - RNA, 22 nt, Artificial Sequence
  Synthetic construct: hsa-miR-5702
ugggauauguugcugacucauu

SEQ ID NO: 2536 - RNA, 18 nt, Artificial Sequence
  Synthetic construct: hsa-miR-5703
aggagaagucgggaaggu

SEQ ID NO: 2537 - RNA, 18 nt, Artificial Sequence
  Synthetic construct: hsa-miR-5703
cuucccgacuucuccuuu

SEQ ID NO: 2538 - RNA, 22 nt, Artificial Sequence
  Synthetic construct: hsa-miR-5704
uuaggccaucaucccauuaugc

SEQ ID NO: 2539 - RNA, 22 nt, Artificial Sequence
  Synthetic construct: hsa-miR-5704
auaaugggaugauggccuaauu

SEQ ID NO: 2540 - RNA, 23 nt, Artificial Sequence
  Synthetic construct: hsa-miR-5705
uguuucggggcucauggccugug

SEQ ID NO: 2541 - RNA, 23 nt, Artificial Sequence
  Synthetic construct: hsa-miR-5705
caggccaugagccccgaaacauu

SEQ ID NO: 2542 - RNA, 22 nt, Artificial Sequence
  Synthetic construct: hsa-miR-5706
uucuggauaacaugcugaagcu

SEQ ID NO: 2543 - RNA, 22 nt, Artificial Sequence
  Synthetic construct: hsa-miR-5706
cuucagcauguuauccagaauu

SEQ ID NO: 2544 - RNA, 22 nt, Artificial Sequence
  Synthetic construct: hsa-miR-5707
acguuugaaugcuguacaaggc

SEQ ID NO: 2545 - RNA, 22 nt, Artificial Sequence
  Synthetic construct: hsa-miR-5707
cuuguacagcauucaaacguuu

SEQ ID NO: 2546 - RNA, 20 nt, Artificial Sequence
  Synthetic construct: hsa-miR-5708
augagcgacugugccugacc

SEQ ID NO: 2547 - RNA, 20 nt, Artificial Sequence
  Synthetic construct: hsa-miR-5708
ucaggcacagucgcucauuu

SEQ ID NO: 2548 - RNA, 21 nt, Artificial Sequence
  Synthetic construct: hsa-miR-571
ugaguuggccaucugagugag

SEQ ID NO: 2549 - RNA, 21 nt, Artificial Sequence
  Synthetic construct: hsa-miR-571
cacucagauggccaacucauu

SEQ ID NO: 2550 - RNA, 20 nt, Artificial Sequence
  Synthetic construct: hsa-miR-572
guccgcucggcgguggccca

SEQ ID NO: 2551 - RNA, 20 nt, Artificial Sequence
  Synthetic construct: hsa-miR-572
ggccaccgccgagcggacuu

SEQ ID NO: 2552 - RNA, 24 nt, Artificial Sequence
  Synthetic construct: hsa-miR-573
cugaagugauguguaacugaucag

SEQ ID NO: 2553 - RNA, 24 nt, Artificial Sequence
  Synthetic construct: hsa-miR-573
gaucaguuacacaucacuucaguu

SEQ ID NO: 2554 - RNA, 20 nt, Artificial Sequence
  Synthetic construct: hsa-miR-5739
gcggagagagaauggggagc

SEQ ID NO: 2555 - RNA, 20 nt, Artificial Sequence
  Synthetic construct: hsa-miR-5739
uccccauucucucuccgcuu

SEQ ID NO: 2556 - RNA, 23 nt, Artificial Sequence
  Synthetic construct: hsa-miR-574
ugagugugugugugugagugugu

SEQ ID NO: 2557 - RNA, 22 nt, Artificial Sequence
  Synthetic construct: hsa-miR-574
cacgcucaugcacacacccaca

SEQ ID NO: 2558 - RNA, 19 nt, Artificial Sequence
  Synthetic construct: hsa-miR-575
gagccaguuggacaggagc

SEQ ID NO: 2559 - RNA, 19 nt, Artificial Sequence
  Synthetic construct: hsa-miR-575
uccuguccaacuggcucuu

SEQ ID NO: 2560 - RNA, 22 nt, Artificial Sequence
  Synthetic construct: hsa-miR-576
aagauguggaaaaauuggaauc

SEQ ID NO: 2561 - RNA, 22 nt, Artificial Sequence
  Synthetic construct: hsa-miR-576
auucuaauuucuccacgucuuu

SEQ ID NO: 2562 - RNA, 21 nt, Artificial Sequence
  Synthetic construct: hsa-miR-577
uagauaaaauauugguaccug

SEQ ID NO: 2563 - RNA, 21 nt, Artificial Sequence
  Synthetic construct: hsa-miR-577
gguaccaauauuuuaucuauu

SEQ ID NO: 2564 - RNA, 21 nt, Artificial Sequence
  Synthetic construct: hsa-miR-578
cuucuugugcucuaggauugu

SEQ ID NO: 2565 - RNA, 21 nt, Artificial Sequence
  Synthetic construct: hsa-miR-578
aauccuagagcacaagaaguu

SEQ ID NO: 2566 - RNA, 20 nt, Artificial Sequence
  Synthetic construct: hsa-miR-5787
gggcuggggcgcggggaggu

SEQ ID NO: 2567 - RNA, 20 nt, Artificial Sequence
  Synthetic construct: hsa-miR-5787
cuccccgcgccccagcccuu

SEQ ID NO: 2568 - RNA, 23 nt, Artificial Sequence
  Synthetic construct: hsa-miR-579
uucauuugguauaaaccgcgauu

SEQ ID NO: 2569 - RNA, 22 nt, Artificial Sequence
  Synthetic construct: hsa-miR-579
ucgcgguuugugccagaugacg

SEQ ID NO: 2570 - RNA, 22 nt, Artificial Sequence
  Synthetic construct: hsa-miR-580
uaaugauucaucagacucagau

SEQ ID NO: 2571 - RNA, 22 nt, Artificial Sequence
  Synthetic construct: hsa-miR-580
uugagaaugaugaaucauuagg

SEQ ID NO: 2572 - RNA, 21 nt, Artificial Sequence
  Synthetic construct: hsa-miR-581
ucuuguguucucuagaucagu

SEQ ID NO: 2573 - RNA, 21 nt, Artificial Sequence
  Synthetic construct: hsa-miR-581
ugaucuagagaacacaagauu

SEQ ID NO: 2574 - RNA, 23 nt, Artificial Sequence
  Synthetic construct: hsa-miR-582
uuacaguuguucaaccaguuacu

SEQ ID NO: 2575 - RNA, 22 nt, Artificial Sequence
  Synthetic construct: hsa-miR-582
uaacugguugaacaacugaacc

SEQ ID NO: 2576 - RNA, 21 nt, Artificial Sequence
  Synthetic construct: hsa-miR-583
caaagaggaaggucccauuac

SEQ ID NO: 2577 - RNA, 21 nt, Artificial Sequence
  Synthetic construct: hsa-miR-583
aaugggaccuuccucuuuguu

SEQ ID NO: 2578 - RNA, 22 nt, Artificial Sequence
  Synthetic construct: hsa-miR-584
uuaugguuugccugggacugag

SEQ ID NO: 2579 - RNA, 22 nt, Artificial Sequence
  Synthetic construct: hsa-miR-584
ucaguuccaggccaaccaggcu

SEQ ID NO: 2580 - RNA, 19 nt, Artificial Sequence
  Synthetic construct: hsa-miR-585
ugggcguaucuguaugcua

SEQ ID NO: 2581 - RNA, 22 nt, Artificial Sequence
  Synthetic construct: hsa-miR-585
cuagcacacagauacgcccaga

SEQ ID NO: 2582 - RNA, 22 nt, Artificial Sequence
  Synthetic construct: hsa-miR-586
uaugcauuguauuuuuaggucc

SEQ ID NO: 2583 - RNA, 22 nt, Artificial Sequence
  Synthetic construct: hsa-miR-586
accuaaaaauacaaugcauauu

SEQ ID NO: 2584 - RNA, 21 nt, Artificial Sequence
  Synthetic construct: hsa-miR-587
uuuccauaggugaugagucac

SEQ ID NO: 2585 - RNA, 21 nt, Artificial Sequence
  Synthetic construct: hsa-miR-587
gacucaucaccuauggaaauu

SEQ ID NO: 2586 - RNA, 21 nt, Artificial Sequence
  Synthetic construct: hsa-miR-588
uuggccacaauggguuagaac

SEQ ID NO: 2587 - RNA, 21 nt, Artificial Sequence
  Synthetic construct: hsa-miR-588
ucuaacccauuguggccaauu

SEQ ID NO: 2588 - RNA, 24 nt, Artificial Sequence
  Synthetic construct: hsa-miR-589
ucagaacaaaugccgguucccaga

SEQ ID NO: 2589 - RNA, 22 nt, Artificial Sequence
  Synthetic construct: hsa-miR-589
ugagaaccacgucugcucugag

SEQ ID NO: 2590 - RNA, 22 nt, Artificial Sequence
  Synthetic construct: hsa-miR-590
gagcuuauucauaaaagugcag

SEQ ID NO: 2591 - RNA, 21 nt, Artificial Sequence
  Synthetic construct: hsa-miR-590
uaauuuuauguauaagcuagu

SEQ ID NO: 2592 - RNA, 20 nt, Artificial Sequence
  Synthetic construct: hsa-miR-591
agaccauggguucucauugu

SEQ ID NO: 2593 - RNA, 20 nt, Artificial Sequence
  Synthetic construct: hsa-miR-591
aaugagaacccauggucuuu

SEQ ID NO: 2594 - RNA, 22 nt, Artificial Sequence
  Synthetic construct: hsa-miR-592
uugugucaauaugcgaugaugu

SEQ ID NO: 2595 - RNA, 22 nt, Artificial Sequence
  Synthetic construct: hsa-miR-592
aucaucgcauauugacacaauu

SEQ ID NO: 2596 - RNA, 19 nt, Artificial Sequence
  Synthetic construct: hsa-miR-593
ugucucugcugggguuucu

SEQ ID NO: 2597 - RNA, 25 nt, Artificial Sequence
  Synthetic construct: hsa-miR-593
aggcaccagccaggcauugcucagc

SEQ ID NO: 2598 - RNA, 21 nt, Artificial Sequence
  Synthetic construct: hsa-miR-595
gaagugugccguggugugucu

SEQ ID NO: 2599 - RNA, 21 nt, Artificial Sequence
  Synthetic construct: hsa-miR-595
acacaccacggcacacuucuu

SEQ ID NO: 2600 - RNA, 21 nt, Artificial Sequence
  Synthetic construct: hsa-miR-596
aagccugcccggcuccucggg

SEQ ID NO: 2601 - RNA, 21 nt, Artificial Sequence
  Synthetic construct: hsa-miR-596
cgaggagccgggcaggcuuuu

SEQ ID NO: 2602 - RNA, 23 nt, Artificial Sequence
  Synthetic construct: hsa-miR-597
ugguucucuuguggcucaagcgu

SEQ ID NO: 2603 - RNA, 22 nt, Artificial Sequence
  Synthetic construct: hsa-miR-597
ugugucacucgaugaccacugu

SEQ ID NO: 2604 - RNA, 22 nt, Artificial Sequence
  Synthetic construct: hsa-miR-598
uacgucaucguugucaucguca

SEQ ID NO: 2605 - RNA, 23 nt, Artificial Sequence
  Synthetic construct: hsa-miR-598
gcggugaucccgauggugugagc

SEQ ID NO: 2606 - RNA, 20 nt, Artificial Sequence
  Synthetic construct: hsa-miR-599
guugugucaguuuaucaaac

SEQ ID NO: 2607 - RNA, 20 nt, Artificial Sequence
  Synthetic construct: hsa-miR-599
uugauaaacugacacaacuu

SEQ ID NO: 2608 - RNA, 23 nt, Artificial Sequence
  Synthetic construct: hsa-miR-600
acuuacagacaagagccuugcuc

SEQ ID NO: 2609 - RNA, 23 nt, Artificial Sequence
  Synthetic construct: hsa-miR-600
gcaaggcucuugucuguaaguuu

SEQ ID NO: 2610 - RNA, 22 nt, Artificial Sequence
  Synthetic construct: hsa-miR-601
uggucuaggauuguuggaggag

SEQ ID NO: 2611 - RNA, 22 nt, Artificial Sequence
  Synthetic construct: hsa-miR-601
ccuccaacaauccuagaccauu

SEQ ID NO: 2612 - RNA, 23 nt, Artificial Sequence
  Synthetic construct: hsa-miR-602
gacacgggcgacagcugcggccc

SEQ ID NO: 2613 - RNA, 23 nt, Artificial Sequence
  Synthetic construct: hsa-miR-602
gccgcagcugucgcccgugucuu

SEQ ID NO: 2614 - RNA, 22 nt, Artificial Sequence
  Synthetic construct: hsa-miR-603
cacacacugcaauuacuuuugc

SEQ ID NO: 2615 - RNA, 22 nt, Artificial Sequence
  Synthetic construct: hsa-miR-603
aaaaguaauugcaguguguguu

SEQ ID NO: 2616 - RNA, 19 nt, Artificial Sequence
  Synthetic construct: hsa-miR-604
aggcugcggaauucaggac

SEQ ID NO: 2617 - RNA, 19 nt, Artificial Sequence
  Synthetic construct: hsa-miR-604
ccugaauuccgcagccuuu

SEQ ID NO: 2618 - RNA, 22 nt, Artificial Sequence
  Synthetic construct: hsa-miR-605
agaaggcacuaugagauuuaga

SEQ ID NO: 2619 - RNA, 23 nt, Artificial Sequence
  Synthetic construct: hsa-miR-605
uaaaucccauggugccuucuccu

SEQ ID NO: 2620 - RNA, 21 nt, Artificial Sequence
  Synthetic construct: hsa-miR-606
aaacuacugaaaaucaaagau

SEQ ID NO: 2621 - RNA, 21 nt, Artificial Sequence
  Synthetic construct: hsa-miR-606
cuuugauuuucaguaguuuuu

SEQ ID NO: 2622 - RNA, 21 nt, Artificial Sequence
  Synthetic construct: hsa-miR-6068
ccugcgagucuccggcggugg

SEQ ID NO: 2623 - RNA, 21 nt, Artificial Sequence
  Synthetic construct: hsa-miR-6068
accgccggagacucgcagguu

SEQ ID NO: 2624 - RNA, 21 nt, Artificial Sequence
  Synthetic construct: hsa-miR-6069
gggcuagggccugcugccccc

SEQ ID NO: 2625 - RNA, 21 nt, Artificial Sequence
  Synthetic construct: hsa-miR-6069
gggcagcaggcccuagcccuu

SEQ ID NO: 2626 - RNA, 21 nt, Artificial Sequence
  Synthetic construct: hsa-miR-607
guucaaauccagaucuauaac

SEQ ID NO: 2627 - RNA, 21 nt, Artificial Sequence
  Synthetic construct: hsa-miR-607
uauagaucuggauuugaacuu

SEQ ID NO: 2628 - RNA, 19 nt, Artificial Sequence
  Synthetic construct: hsa-miR-6070
ccgguuccagucccuggag

SEQ ID NO: 2629 - RNA, 19 nt, Artificial Sequence
  Synthetic construct: hsa-miR-6070
ccagggacuggaaccgguu

SEQ ID NO: 2630 - RNA, 19 nt, Artificial Sequence
  Synthetic construct: hsa-miR-6071
uucugcugccggccaaggc

SEQ ID NO: 2631 - RNA, 19 nt, Artificial Sequence
  Synthetic construct: hsa-miR-6071
cuuggccggcagcagaauu

SEQ ID NO: 2632 - RNA, 22 nt, Artificial Sequence
  Synthetic construct: hsa-miR-6072
uccucaucacacugcaccuuag

SEQ ID NO: 2633 - RNA, 22 nt, Artificial Sequence
  Synthetic construct: hsa-miR-6072
aaggugcagugugaugaggauu

SEQ ID NO: 2634 - RNA, 20 nt, Artificial Sequence
  Synthetic construct: hsa-miR-6073
gguagugaguuaucagcuac

SEQ ID NO: 2635 - RNA, 20 nt, Artificial Sequence
  Synthetic construct: hsa-miR-6073
agcugauaacucacuaccuu

SEQ ID NO: 2636 - RNA, 20 nt, Artificial Sequence
  Synthetic construct: hsa-miR-6074
gauauucagaggcuaggugg

SEQ ID NO: 2637 - RNA, 20 nt, Artificial Sequence
  Synthetic construct: hsa-miR-6074
accuagccucugaauaucuu

SEQ ID NO: 2638 - RNA, 21 nt, Artificial Sequence
  Synthetic construct: hsa-miR-6075
acggcccaggcggcauuggug

SEQ ID NO: 2639 - RNA, 21 nt, Artificial Sequence
  Synthetic construct: hsa-miR-6075
ccaaugccgccugggccguuu

SEQ ID NO: 2640 - RNA, 21 nt, Artificial Sequence
  Synthetic construct: hsa-miR-6076
agcaugacagaggagaggugg

SEQ ID NO: 2641 - RNA, 21 nt, Artificial Sequence
  Synthetic construct: hsa-miR-6076
accucuccucugucaugcuuu

SEQ ID NO: 2642 - RNA, 21 nt, Artificial Sequence
  Synthetic construct: hsa-miR-6077
gggaagagcuguacggccuuc

SEQ ID NO: 2643 - RNA, 21 nt, Artificial Sequence
  Synthetic construct: hsa-miR-6077
aggccguacagcucuucccuu

SEQ ID NO: 2644 - RNA, 19 nt, Artificial Sequence
  Synthetic construct: hsa-miR-6078
ccgccugagcuagcugugg

SEQ ID NO: 2645 - RNA, 19 nt, Artificial Sequence
  Synthetic construct: hsa-miR-6078
acagcuagcucaggcgguu

SEQ ID NO: 2646 - RNA, 24 nt, Artificial Sequence
  Synthetic construct: hsa-miR-6079
uuggaagcuuggaccaacuagcug

SEQ ID NO: 2647 - RNA, 24 nt, Artificial Sequence
  Synthetic construct: hsa-miR-6079
gcuaguugguccaagcuuccaauu

SEQ ID NO: 2648 - RNA, 25 nt, Artificial Sequence
  Synthetic construct: hsa-miR-608
aggggugguguugggacagcuccgu

SEQ ID NO: 2649 - RNA, 25 nt, Artificial Sequence
  Synthetic construct: hsa-miR-608
ggagcugucccaacaccaccccuuu

SEQ ID NO: 2650 - RNA, 19 nt, Artificial Sequence
  Synthetic construct: hsa-miR-6080
ucuagugcgggcguucccg

SEQ ID NO: 2651 - RNA, 19 nt, Artificial Sequence
  Synthetic construct: hsa-miR-6080
ggaacgcccgcacuagauu

SEQ ID NO: 2652 - RNA, 24 nt, Artificial Sequence
  Synthetic construct: hsa-miR-6081
aggagcagugccggccaaggcgcc

SEQ ID NO: 2653 - RNA, 24 nt, Artificial Sequence
  Synthetic construct: hsa-miR-6081
cgccuuggccggcacugcuccuuu

SEQ ID NO: 2654 - RNA, 19 nt, Artificial Sequence
  Synthetic construct: hsa-miR-6082
gaauacgucugguugaucc

SEQ ID NO: 2655 - RNA, 19 nt, Artificial Sequence
  Synthetic construct: hsa-miR-6082
aucaaccagacguauucuu

SEQ ID NO: 2656 - RNA, 20 nt, Artificial Sequence
  Synthetic construct: hsa-miR-6083
cuuauaucagaggcuguggg

SEQ ID NO: 2657 - RNA, 20 nt, Artificial Sequence
  Synthetic construct: hsa-miR-6083
cacagccucugauauaaguu

SEQ ID NO: 2658 - RNA, 20 nt, Artificial Sequence
  Synthetic construct: hsa-miR-6084
uuccgccagucgguggccgg

SEQ ID NO: 2659 - RNA, 20 nt, Artificial Sequence
  Synthetic construct: hsa-miR-6084
ggccaccgacuggcggaauu

SEQ ID NO: 2660 - RNA, 19 nt, Artificial Sequence
  Synthetic construct: hsa-miR-6085
aaggggcugggggagcaca

SEQ ID NO: 2661 - RNA, 19 nt, Artificial Sequence
  Synthetic construct: hsa-miR-6085
ugcucccccagccccuuuu

SEQ ID NO: 2662 - RNA, 20 nt, Artificial Sequence
  Synthetic construct: hsa-miR-6086
ggagguugggaagggcagag

SEQ ID NO: 2663 - RNA, 20 nt, Artificial Sequence
  Synthetic construct: hsa-miR-6086
cugcccuucccaaccuccuu

SEQ ID NO: 2664 - RNA, 18 nt, Artificial Sequence
  Synthetic construct: hsa-miR-6087
ugaggcgggggggcgagc

SEQ ID NO: 2665 - RNA, 18 nt, Artificial Sequence
  Synthetic construct: hsa-miR-6087
ucgcccccccgccucauu

SEQ ID NO: 2666 - RNA, 20 nt, Artificial Sequence
  Synthetic construct: hsa-miR-6088
agagaugaagcgggggggcg

SEQ ID NO: 2667 - RNA, 20 nt, Artificial Sequence
  Synthetic construct: hsa-miR-6088
cccccccgcuucaucucuuu

SEQ ID NO: 2668 - RNA, 24 nt, Artificial Sequence
  Synthetic construct: hsa-miR-6089
ggaggccgggguggggcggggcgg

SEQ ID NO: 2669 - RNA, 24 nt, Artificial Sequence
  Synthetic construct: hsa-miR-6089
gccccgccccaccccggccuccuu

SEQ ID NO: 2670 - RNA, 20 nt, Artificial Sequence
  Synthetic construct: hsa-miR-609
aggguguuucucucaucucu

SEQ ID NO: 2671 - RNA, 20 nt, Artificial Sequence
  Synthetic construct: hsa-miR-609
agaugagagaaacacccuuu

SEQ ID NO: 2672 - RNA, 19 nt, Artificial Sequence
  Synthetic construct: hsa-miR-6090
ggggagcgaggggcggggc

SEQ ID NO: 2673 - RNA, 19 nt, Artificial Sequence
  Synthetic construct: hsa-miR-6090
cccgccccucgcuccccuu

SEQ ID NO: 2674 - RNA, 21 nt, Artificial Sequence
  Synthetic construct: hsa-miR-610
ugagcuaaaugugugcuggga

SEQ ID NO: 2675 - RNA, 21 nt, Artificial Sequence
  Synthetic construct: hsa-miR-610
ccagcacacauuuagcucauu

SEQ ID NO: 2676 - RNA, 23 nt, Artificial Sequence
  Synthetic construct: hsa-miR-611
gcgaggaccccucggggucugac

SEQ ID NO: 2677 - RNA, 23 nt, Artificial Sequence
  Synthetic construct: hsa-miR-611
cagaccccgagggguccucgcuu

SEQ ID NO: 2678 - RNA, 25 nt, Artificial Sequence
  Synthetic construct: hsa-miR-612
gcugggcagggcuucugagcuccuu

SEQ ID NO: 2679 - RNA, 25 nt, Artificial Sequence
  Synthetic construct: hsa-miR-612
ggagcucagaagcccugcccagcuu

SEQ ID NO: 2680 - RNA, 20 nt, Artificial Sequence
  Synthetic construct: hsa-miR-6124
gggaaaaggaagggggagga

SEQ ID NO: 2681 - RNA, 20 nt, Artificial Sequence
  Synthetic construct: hsa-miR-6124
cucccccuuccuuuucccuu

SEQ ID NO: 2682 - RNA, 20 nt, Artificial Sequence
  Synthetic construct: hsa-miR-6125
gcggaaggcggagcggcgga

SEQ ID NO: 2683 - RNA, 20 nt, Artificial Sequence
  Synthetic construct: hsa-miR-6125
cgccgcuccgccuuccgcuu

SEQ ID NO: 2684 - RNA, 18 nt, Artificial Sequence
  Synthetic construct: hsa-miR-6126
gugaaggcccggcggaga

SEQ ID NO: 2685 - RNA, 18 nt, Artificial Sequence
  Synthetic construct: hsa-miR-6126
uccgccgggccuucacuu

SEQ ID NO: 2686 - RNA, 19 nt, Artificial Sequence
  Synthetic construct: hsa-miR-6127
ugagggagugggugggagg

SEQ ID NO: 2687 - RNA, 19 nt, Artificial Sequence
  Synthetic construct: hsa-miR-6127
ucccacccacucccucauu

SEQ ID NO: 2688 - RNA, 19 nt, Artificial Sequence
  Synthetic construct: hsa-miR-6128
acuggaauuggagucaaaa

SEQ ID NO: 2689 - RNA, 19 nt, Artificial Sequence
  Synthetic construct: hsa-miR-6128
uugacuccaauuccaguuu

SEQ ID NO: 2690 - RNA, 19 nt, Artificial Sequence
  Synthetic construct: hsa-miR-6129
ugagggaguuggguguaua

SEQ ID NO: 2691 - RNA, 19 nt, Artificial Sequence
  Synthetic construct: hsa-miR-6129
uacacccaacucccucauu

SEQ ID NO: 2692 - RNA, 20 nt, Artificial Sequence
  Synthetic construct: hsa-miR-613
aggaauguuccuucuuugcc

SEQ ID NO: 2693 - RNA, 20 nt, Artificial Sequence
  Synthetic construct: hsa-miR-613
caaagaaggaacauuccuuu

SEQ ID NO: 2694 - RNA, 19 nt, Artificial Sequence
  Synthetic construct: hsa-miR-6130
ugagggaguggauuguaug

SEQ ID NO: 2695 - RNA, 19 nt, Artificial Sequence
  Synthetic construct: hsa-miR-6130
uacaauccacucccucauu

SEQ ID NO: 2696 - RNA, 19 nt, Artificial Sequence
  Synthetic construct: hsa-miR-6131
ggcuggucagaugggagug

SEQ ID NO: 2697 - RNA, 19 nt, Artificial Sequence
  Synthetic construct: hsa-miR-6131
cucccaucugaccagccuu

SEQ ID NO: 2698 - RNA, 19 nt, Artificial Sequence
  Synthetic construct: hsa-miR-6132
agcagggcuggggauugca

SEQ ID NO: 2699 - RNA, 19 nt, Artificial Sequence
  Synthetic construct: hsa-miR-6132
caauccccagcccugcuuu

SEQ ID NO: 2700 - RNA, 19 nt, Artificial Sequence
  Synthetic construct: hsa-miR-6133
ugagggaggagguugggua

SEQ ID NO: 2701 - RNA, 19 nt, Artificial Sequence
  Synthetic construct: hsa-miR-6133
cccaaccuccucccucauu

SEQ ID NO: 2702 - RNA, 19 nt, Artificial Sequence
  Synthetic construct: hsa-miR-6134
ugaggugguaggauguaga

SEQ ID NO: 2703 - RNA, 19 nt, Artificial Sequence
  Synthetic construct: hsa-miR-6134
uacauccuaccaccucauu

SEQ ID NO: 2704 - RNA, 23 nt, Artificial Sequence
  Synthetic construct: hsa-miR-614
gaacgccuguucuugccaggugg

SEQ ID NO: 2705 - RNA, 23 nt, Artificial Sequence
  Synthetic construct: hsa-miR-614
accuggcaagaacaggcguucuu

SEQ ID NO: 2706 - RNA, 22 nt, Artificial Sequence
  Synthetic construct: hsa-miR-615
ggggguccccggugcucggauc

SEQ ID NO: 2707 - RNA, 22 nt, Artificial Sequence
  Synthetic construct: hsa-miR-615
uccgagccugggucucccucuu

SEQ ID NO: 2708 - RNA, 22 nt, Artificial Sequence
  Synthetic construct: hsa-miR-616
acucaaaacccuucagugacuu

SEQ ID NO: 2709 - RNA, 22 nt, Artificial Sequence
  Synthetic construct: hsa-miR-616
agucauuggaggguuugagcag

SEQ ID NO: 2710 - RNA, 19 nt, Artificial Sequence
  Synthetic construct: hsa-miR-6165
cagcaggaggugaggggag

SEQ ID NO: 2711 - RNA, 19 nt, Artificial Sequence
  Synthetic construct: hsa-miR-6165
ccccucaccuccugcuguu

SEQ ID NO: 2712 - RNA, 22 nt, Artificial Sequence
  Synthetic construct: hsa-miR-617
agacuucccauuugaagguggc

SEQ ID NO: 2713 - RNA, 22 nt, Artificial Sequence
  Synthetic construct: hsa-miR-617
caccuucaaaugggaagucuuu

SEQ ID NO: 2714 - RNA, 23 nt, Artificial Sequence
  Synthetic construct:
aaacucuacuuguccuucugagu

SEQ ID NO: 2715 - RNA, 23 nt, Artificial Sequence
  Synthetic construct: hsa-miR-618
ucagaaggacaaguagaguuuuu

SEQ ID NO: 2716 - RNA, 22 nt, Artificial Sequence
  Synthetic construct: hsa-miR-619
gcugggauuacaggcaugagcc

SEQ ID NO: 2717 - RNA, 24 nt, Artificial Sequence
  Synthetic construct: hsa-miR-619
gaccuggacauguuugugcccagu

SEQ ID NO: 2718 - RNA, 20 nt, Artificial Sequence
  Synthetic construct: hsa-miR-620
auggagauagauauagaaau

SEQ ID NO: 2719 - RNA, 20 nt, Artificial Sequence
  Synthetic construct: hsa-miR-620
uucuauaucuaucuccauuu

SEQ ID NO: 2720 - RNA, 21 nt, Artificial Sequence
  Synthetic construct: hsa-miR-621
ggcuagcaacagcgcuuaccu

SEQ ID NO: 2721 - RNA, 21 nt, Artificial Sequence
  Synthetic construct: hsa-miR-621
guaagcgcuguugcuagccuu

SEQ ID NO: 2722 - RNA, 21 nt, Artificial Sequence
  Synthetic construct: hsa-miR-622
acagucugcugagguuggagc

SEQ ID NO: 2723 - RNA, 21 nt, Artificial Sequence
  Synthetic construct: hsa-miR-622
uccaaccucagcagacuguuu

SEQ ID NO: 2724 - RNA, 23 nt, Artificial Sequence
  Synthetic construct: hsa-miR-623
aucccuugcaggggcuguugggu

SEQ ID NO: 2725 - RNA, 23 nt, Artificial Sequence
  Synthetic construct: hsa-miR-623
ccaacagccccugcaagggauuu

SEQ ID NO: 2726 - RNA, 22 nt, Artificial Sequence
  Synthetic construct: hsa-miR-624
uaguaccaguaccuuguguuca

SEQ ID NO: 2727 - RNA, 21 nt, Artificial Sequence
  Synthetic construct: hsa-miR-624
cacaagguauugguauuaccu

SEQ ID NO: 2728 - RNA, 21 nt, Artificial Sequence
  Synthetic construct: hsa-miR-625
agggggaaaguucuauagucc

SEQ ID NO: 2729 - RNA, 22 nt, Artificial Sequence
  Synthetic construct: hsa-miR-625
gacuauagaacuuucccccuca

SEQ ID NO: 2730 - RNA, 19 nt, Artificial Sequence
  Synthetic construct: hsa-miR-626
agcugucugaaaaugucuu

SEQ ID NO: 2731 - RNA, 19 nt, Artificial Sequence
  Synthetic construct: hsa-miR-626
gacauuuucagacagcuuu

SEQ ID NO: 2732 - RNA, 20 nt, Artificial Sequence
  Synthetic construct: hsa-miR-627
ucuuuucuuugagacucacu

SEQ ID NO: 2733 - RNA, 22 nt, Artificial Sequence
  Synthetic construct: hsa-miR-627
gugagucucuaagaaaagagga

SEQ ID NO: 2734 - RNA, 21 nt, Artificial Sequence
  Synthetic construct: hsa-miR-628
ucuaguaagaguggcagucga

SEQ ID NO: 2735 - RNA, 22 nt, Artificial Sequence
  Synthetic construct: hsa-miR-628
augcugacauauuuacuagagg

SEQ ID NO: 2736 - RNA, 21 nt, Artificial Sequence
  Synthetic construct: hsa-miR-629
uggguuuacguugggagaacu

SEQ ID NO: 2737 - RNA, 22 nt, Artificial Sequence
  Synthetic construct: hsa-miR-629
guucucccaacguaagcccagc

SEQ ID NO: 2738 - RNA, 22 nt, Artificial Sequence
  Synthetic construct: hsa-miR-630
aguauucuguaccagggaaggu

SEQ ID NO: 2739 - RNA, 22 nt, Artificial Sequence
  Synthetic construct: hsa-miR-630
cuucccugguacagaauacuuu

SEQ ID NO: 2740 - RNA, 21 nt, Artificial Sequence
  Synthetic construct: hsa-miR-631
agaccuggcccagaccucagc

SEQ ID NO: 2741 - RNA, 21 nt, Artificial Sequence
  Synthetic construct: hsa-miR-631
ugaggucugggccaggucuuu

SEQ ID NO: 2742 - RNA, 19 nt, Artificial Sequence
  Synthetic construct: hsa-miR-632
gugucugcuuccuguggga

SEQ ID NO: 2743 - RNA, 19 nt, Artificial Sequence
  Synthetic construct: hsa-miR-632
ccacaggaagcagacacuu

SEQ ID NO: 2744 - RNA, 23 nt, Artificial Sequence
  Synthetic construct: hsa-miR-633
cuaauaguaucuaccacaauaaa

SEQ ID NO: 2745 - RNA, 23 nt, Artificial Sequence
  Synthetic construct: hsa-miR-633
uauugugguagauacuauuaguu

SEQ ID NO: 2746 - RNA, 22 nt, Artificial Sequence
  Synthetic construct: hsa-miR-634
aaccagcaccccaacuuuggac

SEQ ID NO: 2747 - RNA, 22 nt, Artificial Sequence
  Synthetic construct: hsa-miR-634
ccaaaguuggggugcugguuuu

SEQ ID NO: 2748 - RNA, 23 nt, Artificial Sequence
  Synthetic construct: hsa-miR-635
acuugggcacugaaacaaugucc

SEQ ID NO: 2749 - RNA, 23 nt, Artificial Sequence
  Synthetic construct: hsa-miR-635
acauuguuucagugcccaaguuu

SEQ ID NO: 2750 - RNA, 23 nt, Artificial Sequence
  Synthetic construct: hsa-miR-636
ugugcuugcucgucccgcccgca

SEQ ID NO: 2751 - RNA, 23 nt, Artificial Sequence
  Synthetic construct: hsa-miR-636
cgggcgggacgagcaagcacauu

SEQ ID NO: 2752 - RNA, 24 nt, Artificial Sequence
  Synthetic construct: hsa-miR-637
acugggggcuuucgggcucugcgu

SEQ ID NO: 2753 - RNA, 24 nt, Artificial Sequence
  Synthetic construct: hsa-miR-637
gcagagcccgaaagcccccaguuu

SEQ ID NO: 2754 - RNA, 25 nt, Artificial Sequence
  Synthetic construct: hsa-miR-638
agggaucgcgggcggguggcggccu

SEQ ID NO: 2755 - RNA, 25 nt, Artificial Sequence
  Synthetic construct: hsa-miR-638
gccgccacccgcccgcgaucccuuu

SEQ ID NO: 2756 - RNA, 23 nt, Artificial Sequence
  Synthetic construct: hsa-miR-639
aucgcugcgguugcgagcgcugu

SEQ ID NO: 2757 - RNA, 23 nt, Artificial Sequence
  Synthetic construct: hsa-miR-639
agcgcucgcaaccgcagcgauuu

SEQ ID NO: 2758 - RNA, 21 nt, Artificial Sequence
  Synthetic construct: hsa-miR-640
augauccaggaaccugccucu

SEQ ID NO: 2759 - RNA, 21 nt, Artificial Sequence
  Synthetic construct: hsa-miR-640
aggcagguuccuggaucauuu

SEQ ID NO: 2760 - RNA, 24 nt, Artificial Sequence
  Synthetic construct: hsa-miR-641
aaagacauaggauagagucaccuc

SEQ ID NO: 2761 - RNA, 24 nt, Artificial Sequence
  Synthetic construct: hsa-miR-641
ggugacucuauccuaugucuuuuu

SEQ ID NO: 2762 - RNA, 22 nt, Artificial Sequence
  Synthetic construct: hsa-miR-642a
gucccucuccaaaugugucuug

SEQ ID NO: 2763 - RNA, 22 nt, Artificial Sequence
  Synthetic construct: hsa-miR-642a
agacacauuuggagagggaacc

SEQ ID NO: 2764 - RNA, 22 nt, Artificial Sequence
  Synthetic construct: hsa-miR-642b
gguucccucuccaaaugugucu

SEQ ID NO: 2765 - RNA, 22 nt, Artificial Sequence
  Synthetic construct: hsa-miR-642b
agacacauuuggagagggaccc

SEQ ID NO: 2766 - RNA, 22 nt, Artificial Sequence
  Synthetic construct: hsa-miR-643
acuuguaugcuagcucagguag

SEQ ID NO: 2767 - RNA, 22 nt, Artificial Sequence
  Synthetic construct: hsa-miR-643
accugagcuagcauacaaguuu

SEQ ID NO: 2768 - RNA, 19 nt, Artificial Sequence
  Synthetic construct: hsa-miR-644a
aguguggcuuucuuagagc

SEQ ID NO: 2769 - RNA, 19 nt, Artificial Sequence
  Synthetic construct: hsa-miR-644a
ucuaagaaagccacacuuu

SEQ ID NO: 2770 - RNA, 19 nt, Artificial Sequence
  Synthetic construct: hsa-miR-645
ucuaggcugguacugcuga

SEQ ID NO: 2771 - RNA, 19 nt, Artificial Sequence
  Synthetic construct: hsa-miR-645
agcaguaccagccuagauu

SEQ ID NO: 2772 - RNA, 19 nt, Artificial Sequence
  Synthetic construct: hsa-miR-646
aagcagcugccucugaggc

SEQ ID NO: 2773 - RNA, 19 nt, Artificial Sequence
  Synthetic construct: hsa-miR-646
cucagaggcagcugcuuuu

SEQ ID NO: 2774 - RNA, 21 nt, Artificial Sequence
  Synthetic construct: hsa-miR-647
guggcugcacucacuuccuuc

SEQ ID NO: 2775 - RNA, 21 nt, Artificial Sequence
  Synthetic construct: hsa-miR-647
aggaagugagugcagccacuu

SEQ ID NO: 2776 - RNA, 19 nt, Artificial Sequence
  Synthetic construct: hsa-miR-648
aagugugcagggcacuggu

SEQ ID NO: 2777 - RNA, 19 nt, Artificial Sequence
  Synthetic construct: hsa-miR-648
cagugcccugcacacuuuu

SEQ ID NO: 2778 - RNA, 22 nt, Artificial Sequence
  Synthetic construct: hsa-miR-649
aaaccuguguuguucaagaguc

SEQ ID NO: 2779 - RNA, 22 nt, Artificial Sequence
  Synthetic construct: hsa-miR-649
cucuugaacaacacagguuuuu

SEQ ID NO: 2780 - RNA, 22 nt, Artificial Sequence
  Synthetic construct: hsa-miR-6499
agcaguguuuguuuugcccaca

SEQ ID NO: 2781 - RNA, 22 nt, Artificial Sequence
  Synthetic construct: hsa-miR-6499
ucgggcgcaagagcacugcagu

SEQ ID NO: 2782 - RNA, 21 nt, Artificial Sequence
  Synthetic construct: hsa-miR-650
aggaggcagcgcucucaggac

SEQ ID NO: 2783 - RNA, 21 nt, Artificial Sequence
  Synthetic construct: hsa-miR-650
ccugagagcgcugccuccuuu

SEQ ID NO: 2784 - RNA, 21 nt, Artificial Sequence
  Synthetic construct: hsa-miR-6500
acacuuguugggaugaccugc

SEQ ID NO: 2785 - RNA, 24 nt, Artificial Sequence
  Synthetic construct: hsa-miR-6500
aggagcuauccacuccaggugucc

SEQ ID NO: 2786 - RNA, 23 nt, Artificial Sequence
  Synthetic construct: hsa-miR-6501
ccagagcagccugcgguaacagu

SEQ ID NO: 2787 - RNA, 22 nt, Artificial Sequence
  Synthetic construct: hsa-miR-6501
aguugccagggcugccuuuggu

SEQ ID NO: 2788 - RNA, 22 nt, Artificial Sequence
  Synthetic construct: hsa-miR-6502
agcucuagaaagauuguugacc

SEQ ID NO: 2789 - RNA, 21 nt, Artificial Sequence
  Synthetic construct: hsa-miR-6502
uagaccaucuuucuagaguau

SEQ ID NO: 2790 - RNA, 21 nt, Artificial Sequence
  Synthetic construct: hsa-miR-6503
gggacuaggaugcagaccucc

SEQ ID NO: 2791 - RNA, 23 nt, Artificial Sequence
  Synthetic construct: hsa-miR-6503
aggucugcauucaaauccccaga

SEQ ID NO: 2792 - RNA, 20 nt, Artificial Sequence
  Synthetic construct: hsa-miR-6504
cauuacagcacagccauucu

SEQ ID NO: 2793 - RNA, 21 nt, Artificial Sequence
  Synthetic construct: hsa-miR-6504
ucuggcugugcuguaaugcag

SEQ ID NO: 2794 - RNA, 21 nt, Artificial Sequence
  Synthetic construct: hsa-miR-6505
ugacuucuaccucuuccaaag

SEQ ID NO: 2795 - RNA, 22 nt, Artificial Sequence
  Synthetic construct: hsa-miR-6505
uuggaauaggggauaucucagc

SEQ ID NO: 2796 - RNA, 23 nt, Artificial Sequence
  Synthetic construct: hsa-miR-6506
acugggaugucacugaauauggu

SEQ ID NO: 2797 - RNA, 22 nt, Artificial Sequence
  Synthetic construct: hsa-miR-6506
ucguaucagagauuccagacac

SEQ ID NO: 2798 - RNA, 22 nt, Artificial Sequence
  Synthetic construct: hsa-miR-6507
caaaguccuuccuauuuuuccc

SEQ ID NO: 2799 - RNA, 21 nt, Artificial Sequence
  Synthetic construct: hsa-miR-6507
gaagaauaggagggacuuugu

SEQ ID NO: 2800 - RNA, 21 nt, Artificial Sequence
  Synthetic construct: hsa-miR-6508
ucuagaaaugcaugacccacc

SEQ ID NO: 2801 - RNA, 22 nt, Artificial Sequence
  Synthetic construct: hsa-miR-6508
ugggccaugcauuucuagaacu

SEQ ID NO: 2802 - RNA, 21 nt, Artificial Sequence
  Synthetic construct: hsa-miR-6509
auuagguaguggcaguggaac

SEQ ID NO: 2803 - RNA, 22 nt, Artificial Sequence
  Synthetic construct: hsa-miR-6509
uuccacugccacuaccuaauuu

SEQ ID NO: 2804 - RNA, 22 nt, Artificial Sequence
  Synthetic construct: hsa-miR-651
uuuaggauaagcuugacuuuug

SEQ ID NO: 2805 - RNA, 22 nt, Artificial Sequence
  Synthetic construct: hsa-miR-651
aaaggaaaguguauccuaaaag

SEQ ID NO: 2806 - RNA, 22 nt, Artificial Sequence
  Synthetic construct: hsa-miR-6510
cagcaggggagagagaggaguc

SEQ ID NO: 2807 - RNA, 21 nt, Artificial Sequence
  Synthetic construct: hsa-miR-6510
caccgacucugucuccugcag

SEQ ID NO: 2808 - RNA, 23 nt, Artificial Sequence
  Synthetic construct: hsa-miR-6511a
caggcagaaguggggcugacagg

SEQ ID NO: 2809 - RNA, 22 nt, Artificial Sequence
  Synthetic construct: hsa-miR-6511a
ccucaccaucccuucugccugc

SEQ ID NO: 2810 - RNA, 24 nt, Artificial Sequence
  Synthetic construct: hsa-miR-6511b
cugcaggcagaaguggggcugaca

SEQ ID NO: 2811 - RNA, 23 nt, Artificial Sequence
  Synthetic construct: hsa-miR-6511b
ccucaccaccccuucugccugca

SEQ ID NO: 2812 - RNA, 22 nt, Artificial Sequence
  Synthetic construct: hsa-miR-6512
uaccauuagaagagcuggaaga

SEQ ID NO: 2813 - RNA, 22 nt, Artificial Sequence
  Synthetic construct: hsa-miR-6512
uuccagcccuucuaaugguagg

SEQ ID NO: 2814 - RNA, 23 nt, Artificial Sequence
  Synthetic construct: hsa-miR-6513
uuugggauugacgccacaugucu

SEQ ID NO: 2815 - RNA, 21 nt, Artificial Sequence
  Synthetic construct: hsa-miR-6513
ucaagugucaucugucccuag

SEQ ID NO: 2816 - RNA, 21 nt, Artificial Sequence
  Synthetic construct: hsa-miR-6514
cugccuguucuuccacuccag

SEQ ID NO: 2817 - RNA, 23 nt, Artificial Sequence
  Synthetic construct: hsa-miR-6514
uauggaguggacuuucagcuggc

SEQ ID NO: 2818 - RNA, 20 nt, Artificial Sequence
  Synthetic construct: hsa-miR-6515
ucucuucaucuaccccccag

SEQ ID NO: 2819 - RNA, 21 nt, Artificial Sequence
  Synthetic construct: hsa-miR-6515
uuggaggguguggaagacauc

SEQ ID NO: 2820 - RNA, 22 nt, Artificial Sequence
  Synthetic construct: hsa-miR-6516
uuugcaguaacaggugugagca

SEQ ID NO: 2821 - RNA, 22 nt, Artificial Sequence
  Synthetic construct: hsa-miR-6516
aucauguaugauacugcaaaca

SEQ ID NO: 2822 - RNA, 21 nt, Artificial Sequence
  Synthetic construct: hsa-miR-652
aauggcgccacuaggguugug

SEQ ID NO: 2823 - RNA, 25 nt, Artificial Sequence
  Synthetic construct: hsa-miR-652
caacccuaggagagggugccauuca

SEQ ID NO: 2824 - RNA, 21 nt, Artificial Sequence
  Synthetic construct: hsa-miR-653
guguugaaacaaucucuacug

SEQ ID NO: 2825 - RNA, 22 nt, Artificial Sequence
  Synthetic construct: hsa-miR-653
uucacuggaguuuguuucaaua

SEQ ID NO: 2826 - RNA, 22 nt, Artificial Sequence
  Synthetic construct: hsa-miR-654
uggugggccgcagaacaugugc

SEQ ID NO: 2827 - RNA, 22 nt, Artificial Sequence
  Synthetic construct: hsa-miR-654
uaugucugcugaccaucaccuu

SEQ ID NO: 2828 - RNA, 22 nt, Artificial Sequence
  Synthetic construct: hsa-miR-655
agagguuauccguguuauguuc

SEQ ID NO: 2829 - RNA, 22 nt, Artificial Sequence
  Synthetic construct: hsa-miR-655
auaauacaugguuaaccucuuu

SEQ ID NO: 2830 - RNA, 21 nt, Artificial Sequence
  Synthetic construct: hsa-miR-656
agguugccugugagguguuca

SEQ ID NO: 2831 - RNA, 21 nt, Artificial Sequence
  Synthetic construct: hsa-miR-656
aauauuauacagucaaccucu

SEQ ID NO: 2832 - RNA, 23 nt, Artificial Sequence
  Synthetic construct: hsa-miR-657
ggcagguucucacccucucuagg

SEQ ID NO: 2833 - RNA, 23 nt, Artificial Sequence
  Synthetic construct: hsa-miR-657
uagagagggugagaaccugccuu

SEQ ID NO: 2834 - RNA, 25 nt, Artificial Sequence
  Synthetic construct: hsa-miR-658
ggcggagggaaguagguccguuggu

SEQ ID NO: 2835 - RNA, 25 nt, Artificial Sequence
  Synthetic construct: hsa-miR-658
caacggaccuacuucccuccgccuu

SEQ ID NO: 2836 - RNA, 22 nt, Artificial Sequence
  Synthetic construct: hsa-miR-659
aggaccuucccugaaccaagga

SEQ ID NO: 2837 - RNA, 22 nt, Artificial Sequence
  Synthetic construct: hsa-miR-659
cuugguucagggagggucccca

SEQ ID NO: 2838 - RNA, 21 nt, Artificial Sequence
  Synthetic construct: hsa-miR-660
accuccugugugcauggauua

SEQ ID NO: 2839 - RNA, 22 nt, Artificial Sequence
  Synthetic construct: hsa-miR-660
uacccauugcauaucggaguug

SEQ ID NO: 2840 - RNA, 24 nt, Artificial Sequence
  Synthetic construct: hsa-miR-661
ugccugggucucuggccugcgcgu

SEQ ID NO: 2841 - RNA, 24 nt, Artificial Sequence
  Synthetic construct: hsa-miR-661
gcgcaggccagagacccaggcauu

SEQ ID NO: 2842 - RNA, 21 nt, Artificial Sequence
  Synthetic construct: hsa-miR-662
ucccacguuguggcccagcag

SEQ ID NO: 2843 - RNA, 21 nt, Artificial Sequence
  Synthetic construct: hsa-miR-662
gcugggccacaacgugggauu

SEQ ID NO: 2844 - RNA, 22 nt, Artificial Sequence
  Synthetic construct: hsa-miR-663a
aggcggggcgccgcgggaccgc

SEQ ID NO: 2845 - RNA, 22 nt, Artificial Sequence
  Synthetic construct: hsa-miR-663a
ggucccgcggcgccccgccuuu

SEQ ID NO: 2846 - RNA, 22 nt, Artificial Sequence
  Synthetic construct: hsa-miR-663b
gguggcccggccgugccugagg

SEQ ID NO: 2847 - RNA, 22 nt, Artificial Sequence
  Synthetic construct: hsa-miR-663b
ucaggcacggccgggccaccuu

SEQ ID NO: 2848 - RNA, 24 nt, Artificial Sequence
  Synthetic construct: hsa-miR-664a
acuggcuagggaaaaugauuggau

SEQ ID NO: 2849 - RNA, 23 nt, Artificial Sequence
  Synthetic construct: hsa-miR-664a
uauucauuuauccccagccuaca

SEQ ID NO: 2850 - RNA, 22 nt, Artificial Sequence
  Synthetic construct: hsa-miR-664b
uucauuugccucccagccuaca

SEQ ID NO: 2851 - RNA, 24 nt, Artificial Sequence
  Synthetic construct: hsa-miR-664b
ugggcuaagggagaugauugggua

SEQ ID NO: 2852 - RNA, 20 nt, Artificial Sequence
  Synthetic construct: hsa-miR-665
accaggaggcugaggccccu

SEQ ID NO: 2853 - RNA, 20 nt, Artificial Sequence
  Synthetic construct: hsa-miR-665
gggccucagccuccugguuu

SEQ ID NO: 2854 - RNA, 23 nt, Artificial Sequence
  Synthetic construct: hsa-miR-668
ugucacucggcucggcccacuac

SEQ ID NO: 2855 - RNA, 19 nt, Artificial Sequence
  Synthetic construct: hsa-miR-668
ugcgccucgggugagcaug

SEQ ID NO: 2856 - RNA, 21 nt, Artificial Sequence
  Synthetic construct: hsa-miR-670
uuuccucauauucauucagga

SEQ ID NO: 2857 - RNA, 20 nt, Artificial Sequence
  Synthetic construct: hsa-miR-670
gucccugaguguauguggug

SEQ ID NO: 2858 - RNA, 21 nt, Artificial Sequence
  Synthetic construct: hsa-miR-671
uccgguucucagggcuccacc

SEQ ID NO: 2859 - RNA, 23 nt, Artificial Sequence
  Synthetic construct: hsa-miR-671
aggaagcccuggaggggcuggag

SEQ ID NO: 2860 - RNA, 21 nt, Artificial Sequence
  Synthetic construct: hsa-miR-6715a
ccaaaccagucgugccugugg

SEQ ID NO: 2861 - RNA, 21 nt, Artificial Sequence
  Synthetic construct: hsa-miR-6715a
acaggcacgacugguuugguu

SEQ ID NO: 2862 - RNA, 22 nt, Artificial Sequence
  Synthetic construct: hsa-miR-6715b
cucaaaccggcugugccugugg

SEQ ID NO: 2863 - RNA, 21 nt, Artificial Sequence
  Synthetic construct: hsa-miR-6715b
acaggcacgacugguuuggca

SEQ ID NO: 2864 - RNA, 20 nt, Artificial Sequence
  Synthetic construct: hsa-miR-6716
ugggaauggggguaagggcc

SEQ ID NO: 2865 - RNA, 22 nt, Artificial Sequence
  Synthetic construct: hsa-miR-6716
uccgaacucuccauuccucugc

SEQ ID NO: 2866 - RNA, 22 nt, Artificial Sequence
  Synthetic construct: hsa-miR-6717
aggcgauguggggauguagaga

SEQ ID NO: 2867 - RNA, 22 nt, Artificial Sequence
  Synthetic construct: hsa-miR-6717
ucuacauccccacaucgccuuu

SEQ ID NO: 2868 - RNA, 21 nt, Artificial Sequence
  Synthetic construct: hsa-miR-6718
uaguggucagagggcuuauga

SEQ ID NO: 2869 - RNA, 21 nt, Artificial Sequence
  Synthetic construct: hsa-miR-6718
auaagcccucugaccacuauu

SEQ ID NO: 2870 - RNA, 22 nt, Artificial Sequence
  Synthetic construct: hsa-miR-6719
ucugacaucagugauucuccug

SEQ ID NO: 2871 - RNA, 22 nt, Artificial Sequence
  Synthetic construct: hsa-miR-6719
ggagaaucacugaugucagauu

SEQ ID NO: 2872 - RNA, 23 nt, Artificial Sequence
  Synthetic construct: hsa-miR-6720
uuccagcccugguaggcgccgcg

SEQ ID NO: 2873 - RNA, 22 nt, Artificial Sequence
  Synthetic construct: hsa-miR-6720
cgcgccugcaggaacugguaga

SEQ ID NO: 2874 - RNA, 23 nt, Artificial Sequence
  Synthetic construct: hsa-miR-6721
ugggcaggggcuuauuguaggag

SEQ ID NO: 2875 - RNA, 23 nt, Artificial Sequence
  Synthetic construct: hsa-miR-6721
ccuacaauaagccccugcccauu

SEQ ID NO: 2876 - RNA, 22 nt, Artificial Sequence
  Synthetic construct: hsa-miR-6722
ugcaggggucgggugggccagg

SEQ ID NO: 2877 - RNA, 20 nt, Artificial Sequence
  Synthetic construct: hsa-miR-6722
aggcgcacccgaccacaugc

SEQ ID NO: 2878 - RNA, 22 nt, Artificial Sequence
  Synthetic construct: hsa-miR-6723
auaguccgaguaacgucggggc

SEQ ID NO: 2879 - RNA, 22 nt, Artificial Sequence
  Synthetic construct: hsa-miR-6723
cccgacguuacucggacuauuu

SEQ ID NO: 2880 - RNA, 23 nt, Artificial Sequence
  Synthetic construct: hsa-miR-6724
cugggcccgcggcgggcgugggg

SEQ ID NO: 2881 - RNA, 23 nt, Artificial Sequence
  Synthetic construct: hsa-miR-6724
ccacgcccgccgcgggcccaguu

SEQ ID NO: 2882 - RNA, 21 nt, Artificial Sequence
  Synthetic construct: hsa-miR-6726
cgggagcuggggucugcaggu

SEQ ID NO: 2883 - RNA, 20 nt, Artificial Sequence
  Synthetic construct: hsa-miR-6726
cucgcccugucucccgcuag

SEQ ID NO: 2884 - RNA, 20 nt, Artificial Sequence
  Synthetic construct: hsa-miR-6727
uccugccaccuccuccgcag

SEQ ID NO: 2885 - RNA, 23 nt, Artificial Sequence
  Synthetic construct: hsa-miR-6727
cucggggcaggcggcugggagcg

SEQ ID NO: 2886 - RNA, 21 nt, Artificial Sequence
  Synthetic construct: hsa-miR-6728
ucucugcucugcucuccccag

SEQ ID NO: 2887 - RNA, 23 nt, Artificial Sequence
  Synthetic construct: hsa-miR-6728
uugggaugguaggaccagagggg

SEQ ID NO: 2888 - RNA, 21 nt, Artificial Sequence
  Synthetic construct: hsa-miR-6729
ucaucccccucgcccucucag

SEQ ID NO: 2889 - RNA, 22 nt, Artificial Sequence
  Synthetic construct: hsa-miR-6729
ugggcgagggcggcugagcggc

SEQ ID NO: 2890 - RNA, 23 nt, Artificial Sequence
  Synthetic construct: hsa-miR-6730
agaaagguggagggguugucaga

SEQ ID NO: 2891 - RNA, 22 nt, Artificial Sequence
  Synthetic construct: hsa-miR-6730
ccugacaccccaucugcccuca

SEQ ID NO: 2892 - RNA, 22 nt, Artificial Sequence
  Synthetic construct: hsa-miR-6731
ugggagagcaggguauugugga

SEQ ID NO: 2893 - RNA, 21 nt, Artificial Sequence
  Synthetic construct: hsa-miR-6731
ucuauuccccacucuccccag

SEQ ID NO: 2894 - RNA, 20 nt, Artificial Sequence
  Synthetic construct: hsa-miR-6732
uaggggguggcaggcuggcc

SEQ ID NO: 2895 - RNA, 23 nt, Artificial Sequence
  Synthetic construct: hsa-miR-6732
uaacccuguccucucccucccag

SEQ ID NO: 2896 - RNA, 20 nt, Artificial Sequence
  Synthetic construct: hsa-miR-6733
ucagugucuggauuuccuag

SEQ ID NO: 2897 - RNA, 22 nt, Artificial Sequence
  Synthetic construct: hsa-miR-6733
ugggaaagacaaacucagaguu

SEQ ID NO: 2898 - RNA, 23 nt, Artificial Sequence
  Synthetic construct: hsa-miR-6734
cccuucccucacucuucucucag

SEQ ID NO: 2899 - RNA, 23 nt, Artificial Sequence
  Synthetic construct: hsa-miR-6734
uugaggggagaaugagguggaga

SEQ ID NO: 2900 - RNA, 22 nt, Artificial Sequence
  Synthetic construct: hsa-miR-6735
aggccuguggcuccucccucag

SEQ ID NO: 2901 - RNA, 25 nt, Artificial Sequence
  Synthetic construct: hsa-miR-6735
cagggcagagggcacaggaaucuga

SEQ ID NO: 2902 - RNA, 21 nt, Artificial Sequence
  Synthetic construct: hsa-miR-6736
ucagcuccucucuacccacag

SEQ ID NO: 2903 - RNA, 21 nt, Artificial Sequence
  Synthetic construct: hsa-miR-6736
cugggugagggcaucuguggu

SEQ ID NO: 2904 - RNA, 21 nt, Artificial Sequence
  Synthetic construct: hsa-miR-6737
uugggguggucggcccuggag

SEQ ID NO: 2905 - RNA, 22 nt, Artificial Sequence
  Synthetic construct: hsa-miR-6737
ucugugcuucaccccuacccag

SEQ ID NO: 2906 - RNA, 24 nt, Artificial Sequence
  Synthetic construct: hsa-miR-6738
cuucugccugcauucuacucccag

SEQ ID NO: 2907 - RNA, 23 nt, Artificial Sequence
  Synthetic construct: hsa-miR-6738
cgagggguagaagagcacagggg

SEQ ID NO: 2908 - RNA, 21 nt, Artificial Sequence
  Synthetic construct: hsa-miR-6739
auuguucugucuuucucccag

SEQ ID NO: 2909 - RNA, 22 nt, Artificial Sequence
  Synthetic construct: hsa-miR-6739
ugggaaagagaaagaacaagua

SEQ ID NO: 2910 - RNA, 22 nt, Artificial Sequence
  Synthetic construct: hsa-miR-6740
ugucuucucuccucccaaacag

SEQ ID NO: 2911 - RNA, 22 nt, Artificial Sequence
  Synthetic construct: hsa-miR-6740
aguuugggauggagagaggaga

SEQ ID NO: 2912 - RNA, 22 nt, Artificial Sequence
  Synthetic construct: hsa-miR-6741
ucggcucucucccucacccuag

SEQ ID NO: 2913 - RNA, 22 nt, Artificial Sequence
  Synthetic construct: hsa-miR-6741
gugggugcuggugggagccgug

SEQ ID NO: 2914 - RNA, 22 nt, Artificial Sequence
  Synthetic construct: hsa-miR-6742
aguggggugggacccagcuguu

SEQ ID NO: 2915 - RNA, 20 nt, Artificial Sequence
  Synthetic construct: hsa-miR-6742
accuggguuguccccucuag

SEQ ID NO: 2916 - RNA, 22 nt, Artificial Sequence
  Synthetic construct: hsa-miR-6743
aaggggcagggacggguggccc

SEQ ID NO: 2917 - RNA, 23 nt, Artificial Sequence
  Synthetic construct: hsa-miR-6743
agccgcucuucucccugcccaca

SEQ ID NO: 2918 - RNA, 23 nt, Artificial Sequence
  Synthetic construct: hsa-miR-6744
gggccucucuugucauccugcag

SEQ ID NO: 2919 - RNA, 19 nt, Artificial Sequence
  Synthetic construct: hsa-miR-6744
uggaugacaguggaggccu

SEQ ID NO: 2920 - RNA, 21 nt, Artificial Sequence
  Synthetic construct: hsa-miR-6745
uggguggaagaaggucugguu

SEQ ID NO: 2921 - RNA, 21 nt, Artificial Sequence
  Synthetic construct: hsa-miR-6745
ccagaccuucuuccacccauu

SEQ ID NO: 2922 - RNA, 22 nt, Artificial Sequence
  Synthetic construct: hsa-miR-6746
ccgggagaaggagguggccugg

SEQ ID NO: 2923 - RNA, 22 nt, Artificial Sequence
  Synthetic construct: hsa-miR-6746
cagccgccgccugucuccacag

SEQ ID NO: 2924 - RNA, 21 nt, Artificial Sequence
  Synthetic construct: hsa-miR-6747
uccugccuuccucugcaccag

SEQ ID NO: 2925 - RNA, 24 nt, Artificial Sequence
  Synthetic construct: hsa-miR-6747
agggguguggaaagaggcagaaca

SEQ ID NO: 2926 - RNA, 21 nt, Artificial Sequence
  Synthetic construct: hsa-miR-6748
uccugucccugucuccuacag

SEQ ID NO: 2927 - RNA, 22 nt, Artificial Sequence
  Synthetic construct: hsa-miR-6748
ugugggugggaaggacuggauu

SEQ ID NO: 2928 - RNA, 22 nt, Artificial Sequence
  Synthetic construct: hsa-miR-6749
ucgggccugggguugggggagc

SEQ ID NO: 2929 - RNA, 21 nt, Artificial Sequence
  Synthetic construct: hsa-miR-6749
cuccuccccugccuggcccag

SEQ ID NO: 2930 - RNA, 23 nt, Artificial Sequence
  Synthetic construct: hsa-miR-675
uggugcggagagggcccacagug

SEQ ID NO: 2931 - RNA, 20 nt, Artificial Sequence
  Synthetic construct: hsa-miR-675
cuguaugcccucaccgcuca

SEQ ID NO: 2932 - RNA, 24 nt, Artificial Sequence
  Synthetic construct: hsa-miR-6750
cagggaacagcugggugagcugcu

SEQ ID NO: 2933 - RNA, 21 nt, Artificial Sequence
  Synthetic construct: hsa-miR-6750
gaacucacccucugcucccag

SEQ ID NO: 2934 - RNA, 23 nt, Artificial Sequence
  Synthetic construct: hsa-miR-6751
uugggggugagguuggugucugg

SEQ ID NO: 2935 - RNA, 21 nt, Artificial Sequence
  Synthetic construct: hsa-miR-6751
acugagccucucucucuccag

SEQ ID NO: 2936 - RNA, 21 nt, Artificial Sequence
  Synthetic construct: hsa-miR-6752
ucccugcccccauacucccag

SEQ ID NO: 2937 - RNA, 22 nt, Artificial Sequence
  Synthetic construct: hsa-miR-6752
gggggguguggagccagggggc

SEQ ID NO: 2938 - RNA, 22 nt, Artificial Sequence
  Synthetic construct: hsa-miR-6753
uggucugucucugcccuggcac

SEQ ID NO: 2939 - RNA, 22 nt, Artificial Sequence
  Synthetic construct: hsa-miR-6753
caccagggcagagcagggcuga

SEQ ID NO: 2940 - RNA, 22 nt, Artificial Sequence
  Synthetic construct: hsa-miR-6754
ucuucaccugccucugccugca

SEQ ID NO: 2941 - RNA, 22 nt, Artificial Sequence
  Synthetic construct: hsa-miR-6754
ccagggaggcugguuuggagga

SEQ ID NO: 2942 - RNA, 22 nt, Artificial Sequence
  Synthetic construct: hsa-miR-6755
uguugucauguuuuuucccuag

SEQ ID NO: 2943 - RNA, 22 nt, Artificial Sequence
  Synthetic construct: hsa-miR-6755
uaggguagacacugacaacguu

SEQ ID NO: 2944 - RNA, 20 nt, Artificial Sequence
  Synthetic construct: hsa-miR-6756
uccccuuccucccugcccag

SEQ ID NO: 2945 - RNA, 23 nt, Artificial Sequence
  Synthetic construct: hsa-miR-6756
aggguggggcuggagguggggcu

SEQ ID NO: 2946 - RNA, 22 nt, Artificial Sequence
  Synthetic construct: hsa-miR-6757
uagggaugggaggccaggauga

SEQ ID NO: 2947 - RNA, 22 nt, Artificial Sequence
  Synthetic construct: hsa-miR-6757
aacacuggccuugcuaucccca

SEQ ID NO: 2948 - RNA, 20 nt, Artificial Sequence
  Synthetic construct: hsa-miR-6758
acucauucuccucuguccag

SEQ ID NO: 2949 - RNA, 23 nt, Artificial Sequence
  Synthetic construct: hsa-miR-6758
uagagaggggaaggaugugaugu

SEQ ID NO: 2950 - RNA, 22 nt, Artificial Sequence
  Synthetic construct: hsa-miR-6759
uugugggugggcagaagucugu

SEQ ID NO: 2951 - RNA, 22 nt, Artificial Sequence
  Synthetic construct: hsa-miR-6759
ugaccuuugccucuccccucag

SEQ ID NO: 2952 - RNA, 21 nt, Artificial Sequence
  Synthetic construct: hsa-miR-676
cuguccuaagguuguugaguu

SEQ ID NO: 2953 - RNA, 21 nt, Artificial Sequence
  Synthetic construct: hsa-miR-676
ucuucaaccucaggacuugca

SEQ ID NO: 2954 - RNA, 23 nt, Artificial Sequence
  Synthetic construct: hsa-miR-6760
cagggagaagguggaagugcaga

SEQ ID NO: 2955 - RNA, 21 nt, Artificial Sequence
  Synthetic construct: hsa-miR-6760
acacuguccccuucuccccag

SEQ ID NO: 2956 - RNA, 21 nt, Artificial Sequence
  Synthetic construct: hsa-miR-6761
ucugagagagcucgauggcag

SEQ ID NO: 2957 - RNA, 22 nt, Artificial Sequence
  Synthetic construct: hsa-miR-6761
uccuacgcugcucucucacucc

SEQ ID NO: 2958 - RNA, 23 nt, Artificial Sequence
  Synthetic construct: hsa-miR-6762
cggggccauggagcagccugugu

SEQ ID NO: 2959 - RNA, 23 nt, Artificial Sequence
  Synthetic construct: hsa-miR-6762
uggcugcuucccuuggucuccag

SEQ ID NO: 2960 - RNA, 19 nt, Artificial Sequence
  Synthetic construct: hsa-miR-6763
cuggggaguggcuggggag

SEQ ID NO: 2961 - RNA, 21 nt, Artificial Sequence
  Synthetic construct: hsa-miR-6763
cuccccggccucugcccccag

SEQ ID NO: 2962 - RNA, 21 nt, Artificial Sequence
  Synthetic construct: hsa-miR-6764
ucucuggucuuuccuugacag

SEQ ID NO: 2963 - RNA, 22 nt, Artificial Sequence
  Synthetic construct: hsa-miR-6764
ucccagggucuggucagaguug

SEQ ID NO: 2964 - RNA, 21 nt, Artificial Sequence
  Synthetic construct: hsa-miR-6765
ucaccuggcuggcccgcccag

SEQ ID NO: 2965 - RNA, 25 nt, Artificial Sequence
  Synthetic construct: hsa-miR-6765
gugaggcggggccaggagggugugu

SEQ ID NO: 2966 - RNA, 24 nt, Artificial Sequence
  Synthetic construct: hsa-miR-6766
cgggugggagcagaucuuauugag

SEQ ID NO: 2967 - RNA, 22 nt, Artificial Sequence
  Synthetic construct: hsa-miR-6766
ugauugucuucccccacccuca

SEQ ID NO: 2968 - RNA, 23 nt, Artificial Sequence
  Synthetic construct: hsa-miR-6767
ucgcagacagggacacauggaga

SEQ ID NO: 2969 - RNA, 22 nt, Artificial Sequence
  Synthetic construct: hsa-miR-6767
ccacgugcuucucuuuccgcag

SEQ ID NO: 2970 - RNA, 24 nt, Artificial Sequence
  Synthetic construct: hsa-miR-6768
caaaggccacauucuccugugcac

SEQ ID NO: 2971 - RNA, 23 nt, Artificial Sequence
  Synthetic construct: hsa-miR-6768
cacacaggaaaagcggggcccug

SEQ ID NO: 2972 - RNA, 21 nt, Artificial Sequence
  Synthetic construct: hsa-miR-6769a
gagccccucucugcucuccag

SEQ ID NO: 2973 - RNA, 21 nt, Artificial Sequence
  Synthetic construct: hsa-miR-6769a
agguggguauggaggagcccu

SEQ ID NO: 2974 - RNA, 23 nt, Artificial Sequence
  Synthetic construct: hsa-miR-6769b
ugguggguggggaggagaagugc

SEQ ID NO: 2975 - RNA, 21 nt, Artificial Sequence
  Synthetic construct: hsa-miR-6769b
cccucucugucccacccauag

SEQ ID NO: 2976 - RNA, 24 nt, Artificial Sequence
  Synthetic construct: hsa-miR-6770
ugagaaggcacagcuugcacguga

SEQ ID NO: 2977 - RNA, 21 nt, Artificial Sequence
  Synthetic construct: hsa-miR-6770
cuggcggcugugucuucacag

SEQ ID NO: 2978 - RNA, 22 nt, Artificial Sequence
  Synthetic construct: hsa-miR-6771
cucgggagggcaugggccaggc

SEQ ID NO: 2979 - RNA, 21 nt, Artificial Sequence
  Synthetic construct: hsa-miR-6771
caaaccccugucuacccgcag

SEQ ID NO: 2980 - RNA, 22 nt, Artificial Sequence
  Synthetic construct: hsa-miR-6772
uggguguaggcuggagcugagg

SEQ ID NO: 2981 - RNA, 23 nt, Artificial Sequence
  Synthetic construct: hsa-miR-6772
uugcuccugacucugugcccaca

SEQ ID NO: 2982 - RNA, 22 nt, Artificial Sequence
  Synthetic construct: hsa-miR-6773
acugucacuucucugcccauag

SEQ ID NO: 2983 - RNA, 23 nt, Artificial Sequence
  Synthetic construct: hsa-miR-6773
uugggcccaggaguaaacaggau

SEQ ID NO: 2984 - RNA, 25 nt, Artificial Sequence
  Synthetic construct: hsa-miR-6774
acuugggcaggagggacccuguaug

SEQ ID NO: 2985 - RNA, 21 nt, Artificial Sequence
  Synthetic construct: hsa-miR-6774
ucgugucccucuuguccacag

SEQ ID NO: 2986 - RNA, 21 nt, Artificial Sequence
  Synthetic construct: hsa-miR-6775
aggcccuguccucugccccag

SEQ ID NO: 2987 - RNA, 25 nt, Artificial Sequence
  Synthetic construct: hsa-miR-6775
ucggggcaugggggagggaggcugg

SEQ ID NO: 2988 - RNA, 19 nt, Artificial Sequence
  Synthetic construct: hsa-miR-6776
ucugggugcaguggggguu

SEQ ID NO: 2989 - RNA, 23 nt, Artificial Sequence
  Synthetic construct: hsa-miR-6776
caaccaccacugucucuccccag

SEQ ID NO: 2990 - RNA, 20 nt, Artificial Sequence
  Synthetic construct: hsa-miR-6777
uccacucuccuggcccccag

SEQ ID NO: 2991 - RNA, 23 nt, Artificial Sequence
  Synthetic construct: hsa-miR-6777
acggggagucaggcaguggugga

SEQ ID NO: 2992 - RNA, 21 nt, Artificial Sequence
  Synthetic construct: hsa-miR-6778
ugccucccugacauuccacag

SEQ ID NO: 2993 - RNA, 22 nt, Artificial Sequence
  Synthetic construct: hsa-miR-6778
agugggaggacaggaggcaggu

SEQ ID NO: 2994 - RNA, 21 nt, Artificial Sequence
  Synthetic construct: hsa-miR-6779
aagcccugucuccucccaucu

SEQ ID NO: 2995 - RNA, 21 nt, Artificial Sequence
  Synthetic construct: hsa-miR-6779
cugggaggggcuggguuuggc

SEQ ID NO: 2996 - RNA, 21 nt, Artificial Sequence
  Synthetic construct: hsa-miR-6780a
cuccucuguuuucuuuccuag

SEQ ID NO: 2997 - RNA, 23 nt, Artificial Sequence
  Synthetic construct: hsa-miR-6780a
uugggagggaagacagcuggaga

SEQ ID NO: 2998 - RNA, 21 nt, Artificial Sequence
  Synthetic construct: hsa-miR-6780b
ucccuugucuccuuucccuag

SEQ ID NO: 2999 - RNA, 23 nt, Artificial Sequence
  Synthetic construct: hsa-miR-6780b
uggggaaggcuuggcagggaaga

SEQ ID NO: 3000 - RNA, 21 nt, Artificial Sequence
  Synthetic construct: hsa-miR-6781
cgggccggaggucaagggcgu

SEQ ID NO: 3001 - RNA, 22 nt, Artificial Sequence
  Synthetic construct: hsa-miR-6781
ugccucuuuuccacggccucag

SEQ ID NO: 3002 - RNA, 25 nt, Artificial Sequence
  Synthetic construct: hsa-miR-6782
uaggggugggggaauucaggggugu

SEQ ID NO: 3003 - RNA, 23 nt, Artificial Sequence
  Synthetic construct: hsa-miR-6782
caccuuuguguccccauccugca

SEQ ID NO: 3004 - RNA, 22 nt, Artificial Sequence
  Synthetic construct: hsa-miR-6783
uuccugggcuucuccucuguag

SEQ ID NO: 3005 - RNA, 22 nt, Artificial Sequence
  Synthetic construct: hsa-miR-6783
uaggggaaaaguccugauccgg

SEQ ID NO: 3006 - RNA, 22 nt, Artificial Sequence
  Synthetic construct: hsa-miR-6784
ucucaccccaacucugccccag

SEQ ID NO: 3007 - RNA, 20 nt, Artificial Sequence
  Synthetic construct: hsa-miR-6784
gccggggcuuugggugaggg

SEQ ID NO: 3008 - RNA, 21 nt, Artificial Sequence
  Synthetic construct: hsa-miR-6785
acaucgccccaccuuccccag

SEQ ID NO: 3009 - RNA, 22 nt, Artificial Sequence
  Synthetic construct: hsa-miR-6785
ugggagggcguggaugauggug

SEQ ID NO: 3010 - RNA, 23 nt, Artificial Sequence
  Synthetic construct: hsa-miR-6786
ugacgccccuucugauucugccu

SEQ ID NO: 3011 - RNA, 21 nt, Artificial Sequence
  Synthetic construct: hsa-miR-6786
gcgguggggccggaggggcgu

SEQ ID NO: 3012 - RNA, 22 nt, Artificial Sequence
  Synthetic construct: hsa-miR-6787
ucucagcugcugcccucuccag

SEQ ID NO: 3013 - RNA, 22 nt, Artificial Sequence
  Synthetic construct: hsa-miR-6787
uggcggggguagagcuggcugc

SEQ ID NO: 3014 - RNA, 21 nt, Artificial Sequence
  Synthetic construct: hsa-miR-6788
cugggagaagaguggugaaga

SEQ ID NO: 3015 - RNA, 22 nt, Artificial Sequence
  Synthetic construct: hsa-miR-6788
uucgccacuucccucccugcag

SEQ ID NO: 3016 - RNA, 21 nt, Artificial Sequence
  Synthetic construct: hsa-miR-6789
cggcgcccgugucuccuccag

SEQ ID NO: 3017 - RNA, 24 nt, Artificial Sequence
  Synthetic construct: hsa-miR-6789
guaggggcgucccgggcgcgcggg

SEQ ID NO: 3018 - RNA, 23 nt, Artificial Sequence
  Synthetic construct: hsa-miR-6790
gugaguguggauuuggcgggguu

SEQ ID NO: 3019 - RNA, 21 nt, Artificial Sequence
  Synthetic construct: hsa-miR-6790
cgaccucggcgaccccucacu

SEQ ID NO: 3020 - RNA, 22 nt, Artificial Sequence
  Synthetic construct: hsa-miR-6791
ccccuggggcugggcaggcgga

SEQ ID NO: 3021 - RNA, 21 nt, Artificial Sequence
  Synthetic construct: hsa-miR-6791
ugccuccuuggucuccggcag

SEQ ID NO: 3022 - RNA, 22 nt, Artificial Sequence
  Synthetic construct: hsa-miR-6792
cuccuccacagccccugcucau

SEQ ID NO: 3023 - RNA, 21 nt, Artificial Sequence
  Synthetic construct: hsa-miR-6792
guaagcaggggcucuggguga

SEQ ID NO: 3024 - RNA, 22 nt, Artificial Sequence
  Synthetic construct: hsa-miR-6793
uguggguucuggguugggguga

SEQ ID NO: 3025 - RNA, 20 nt, Artificial Sequence
  Synthetic construct: hsa-miR-6793
uccccaaccccugcccgcag

SEQ ID NO: 3026 - RNA, 20 nt, Artificial Sequence
  Synthetic construct: hsa-miR-6794
cagggggacugggggugagc

SEQ ID NO: 3027 - RNA, 20 nt, Artificial Sequence
  Synthetic construct: hsa-miR-6794
cucacucucagucccucccu

SEQ ID NO: 3028 - RNA, 24 nt, Artificial Sequence
  Synthetic construct: hsa-miR-6795
uggggggacaggaugagaggcugu

SEQ ID NO: 3029 - RNA, 21 nt, Artificial Sequence
  Synthetic construct: hsa-miR-6795
accccucguuucuucccccag

SEQ ID NO: 3030 - RNA, 21 nt, Artificial Sequence
  Synthetic construct: hsa-miR-6796
gaagcucuccccuccccgcag

SEQ ID NO: 3031 - RNA, 23 nt, Artificial Sequence
  Synthetic construct: hsa-miR-6796
uugugggguuggagagcuggcug

SEQ ID NO: 3032 - RNA, 22 nt, Artificial Sequence
  Synthetic construct: hsa-miR-6797
ugcaugacccuucccuccccac

SEQ ID NO: 3033 - RNA, 25 nt, Artificial Sequence
  Synthetic construct: hsa-miR-6797
aggagggaaggggcugagaacagga

SEQ ID NO: 3034 - RNA, 23 nt, Artificial Sequence
  Synthetic construct: hsa-miR-6798
ccagggggaugggcgagcuuggg

SEQ ID NO: 3035 - RNA, 21 nt, Artificial Sequence
  Synthetic construct: hsa-miR-6798
cuaccccccaucccccuguag

SEQ ID NO: 3036 - RNA, 20 nt, Artificial Sequence
  Synthetic construct: hsa-miR-6799
ggggaggugugcagggcugg

SEQ ID NO: 3037 - RNA, 23 nt, Artificial Sequence
  Synthetic construct: hsa-miR-6799
ugcccugcaugguguccccacag

SEQ ID NO: 3038 - RNA, 21 nt, Artificial Sequence
  Synthetic construct: hsa-miR-6800
guaggugacagucaggggcgg

SEQ ID NO: 3039 - RNA, 21 nt, Artificial Sequence
  Synthetic construct: hsa-miR-6800
caccucuccuggcaucgcccc

SEQ ID NO: 3040 - RNA, 23 nt, Artificial Sequence
  Synthetic construct: hsa-miR-6801
uggucagaggcagcaggaaauga

SEQ ID NO: 3041 - RNA, 20 nt, Artificial Sequence
  Synthetic construct: hsa-miR-6801
accccugccacucacuggcc

SEQ ID NO: 3042 - RNA, 22 nt, Artificial Sequence
  Synthetic construct: hsa-miR-6802
uucaccccucucaccuaagcag

SEQ ID NO: 3043 - RNA, 20 nt, Artificial Sequence
  Synthetic construct: hsa-miR-6802
cuagguggggggcuugaagc

SEQ ID NO: 3044 - RNA, 22 nt, Artificial Sequence
  Synthetic construct: hsa-miR-6803
ucccucgccuucucacccucag

SEQ ID NO: 3045 - RNA, 22 nt, Artificial Sequence
  Synthetic construct: hsa-miR-6803
cuggggguggggggcugggcgu

SEQ ID NO: 3046 - RNA, 21 nt, Artificial Sequence
  Synthetic construct: hsa-miR-6804
ugagggugucagcaggugacg

SEQ ID NO: 3047 - RNA, 22 nt, Artificial Sequence
  Synthetic construct: hsa-miR-6804
cgcaccugccucucacccacag

SEQ ID NO: 3048 - RNA, 23 nt, Artificial Sequence
  Synthetic construct: hsa-miR-6805
uugcucugcucccccgcccccag

SEQ ID NO: 3049 - RNA, 22 nt, Artificial Sequence
  Synthetic construct: hsa-miR-6805
uagggggcggcuuguggagugu

SEQ ID NO: 3050 - RNA, 22 nt, Artificial Sequence
  Synthetic construct: hsa-miR-6806
ugaagcucugacauuccugcag

SEQ ID NO: 3051 - RNA, 24 nt, Artificial Sequence
  Synthetic construct: hsa-miR-6806
uguaggcaugaggcagggcccagg

SEQ ID NO: 3052 - RNA, 22 nt, Artificial Sequence
  Synthetic construct: hsa-miR-6807
gugagccaguggaauggagagg

SEQ ID NO: 3053 - RNA, 23 nt, Artificial Sequence
  Synthetic construct: hsa-miR-6807
cacugcauuccugcuuggcccag

SEQ ID NO: 3054 - RNA, 22 nt, Artificial Sequence
  Synthetic construct: hsa-miR-6808
caggcagggaggugggaccaug

SEQ ID NO: 3055 - RNA, 21 nt, Artificial Sequence
  Synthetic construct: hsa-miR-6808
gugugaccaccguuccugcag

SEQ ID NO: 3056 - RNA, 21 nt, Artificial Sequence
  Synthetic construct: hsa-miR-6809
cuucucuucucuccuucccag

SEQ ID NO: 3057 - RNA, 22 nt, Artificial Sequence
  Synthetic construct: hsa-miR-6809
uggcaaggaaagaagaggauca

SEQ ID NO: 3058 - RNA, 23 nt, Artificial Sequence
  Synthetic construct: hsa-miR-6810
auggggacagggaucagcauggc

SEQ ID NO: 3059 - RNA, 23 nt, Artificial Sequence
  Synthetic construct: hsa-miR-6810
uccccugcucccuuguuccccag

SEQ ID NO: 3060 - RNA, 21 nt, Artificial Sequence
  Synthetic construct: hsa-miR-6811
agccugugcuugucccugcag

SEQ ID NO: 3061 - RNA, 22 nt, Artificial Sequence
  Synthetic construct: hsa-miR-6811
augcaggccuguguacagcacu

SEQ ID NO: 3062 - RNA, 25 nt, Artificial Sequence
  Synthetic construct: hsa-miR-6812
auggggugagauggggaggagcagc

SEQ ID NO: 3063 - RNA, 21 nt, Artificial Sequence
  Synthetic construct: hsa-miR-6812
ccgcucuuccccugaccccag

SEQ ID NO: 3064 - RNA, 23 nt, Artificial Sequence
  Synthetic construct: hsa-miR-6813
caggggcugggguuucagguucu

SEQ ID NO: 3065 - RNA, 21 nt, Artificial Sequence
  Synthetic construct: hsa-miR-6813
aaccuuggccccucuccccag

SEQ ID NO: 3066 - RNA, 22 nt, Artificial Sequence
  Synthetic construct: hsa-miR-6814
acucgcauccuucccuuggcag

SEQ ID NO: 3067 - RNA, 22 nt, Artificial Sequence
  Synthetic construct: hsa-miR-6814
ucccaagggugagaugcugcca

SEQ ID NO: 3068 - RNA, 23 nt, Artificial Sequence
  Synthetic construct: hsa-miR-6815
uagguggcgccggaggagucauu

SEQ ID NO: 3069 - RNA, 21 nt, Artificial Sequence
  Synthetic construct: hsa-miR-6815
uggcuucucuugcacacccag

SEQ ID NO: 3070 - RNA, 21 nt, Artificial Sequence
  Synthetic construct: hsa-miR-6816
uggggcggggcaggucccugc

SEQ ID NO: 3071 - RNA, 18 nt, Artificial Sequence
  Synthetic construct: hsa-miR-6816
gaaggaccugcaccuucg

SEQ ID NO: 3072 - RNA, 24 nt, Artificial Sequence
  Synthetic construct: hsa-miR-6817
ucugccauaggaagcuuggagugg

SEQ ID NO: 3073 - RNA, 19 nt, Artificial Sequence
  Synthetic construct: hsa-miR-6817
ucucucugacuccauggca

SEQ ID NO: 3074 - RNA, 22 nt, Artificial Sequence
  Synthetic construct: hsa-miR-6818
uugugugaguacagagagcauc

SEQ ID NO: 3075 - RNA, 22 nt, Artificial Sequence
  Synthetic construct: hsa-miR-6818
uugucucuuguuccucacacag

SEQ ID NO: 3076 - RNA, 22 nt, Artificial Sequence
  Synthetic construct: hsa-miR-6819
uugggguggagggccaaggagc

SEQ ID NO: 3077 - RNA, 21 nt, Artificial Sequence
  Synthetic construct: hsa-miR-6819
aagccucuguccccaccccag

SEQ ID NO: 3078 - RNA, 19 nt, Artificial Sequence
  Synthetic construct: hsa-miR-6820
ugcggcagagcugggguca

SEQ ID NO: 3079 - RNA, 22 nt, Artificial Sequence
  Synthetic construct: hsa-miR-6820
ugugacuucuccccugccacag

SEQ ID NO: 3080 - RNA, 23 nt, Artificial Sequence
  Synthetic construct: hsa-miR-6821
gugcgugguggcucgaggcgggg

SEQ ID NO: 3081 - RNA, 21 nt, Artificial Sequence
  Synthetic construct: hsa-miR-6821
ugaccucuccgcuccgcacag

SEQ ID NO: 3082 - RNA, 24 nt, Artificial Sequence
  Synthetic construct: hsa-miR-6822
aggcucuaacuggcuuucccugca

SEQ ID NO: 3083 - RNA, 20 nt, Artificial Sequence
  Synthetic construct: hsa-miR-6822
cagggaaccaguuggggcuu

SEQ ID NO: 3084 - RNA, 21 nt, Artificial Sequence
  Synthetic construct: hsa-miR-6823
ucaggguugguagggguugcu

SEQ ID NO: 3085 - RNA, 21 nt, Artificial Sequence
  Synthetic construct: hsa-miR-6823
ugagccucuccuucccuccag

SEQ ID NO: 3086 - RNA, 22 nt, Artificial Sequence
  Synthetic construct: hsa-miR-6824
guaggggagguugggccaggga

SEQ ID NO: 3087 - RNA, 21 nt, Artificial Sequence
  Synthetic construct: hsa-miR-6824
ucucuggucuugccaccccag

SEQ ID NO: 3088 - RNA, 22 nt, Artificial Sequence
  Synthetic construct: hsa-miR-6825
gcgcugacccgccuucuccgca

SEQ ID NO: 3089 - RNA, 22 nt, Artificial Sequence
  Synthetic construct: hsa-miR-6825
uggggagguguggagucagcau

SEQ ID NO: 3090 - RNA, 22 nt, Artificial Sequence
  Synthetic construct: hsa-miR-6826
cuccccucucuuuccuguucag

SEQ ID NO: 3091 - RNA, 23 nt, Artificial Sequence
  Synthetic construct: hsa-miR-6826
ucaauaggaaagaggugggaccu

SEQ ID NO: 3092 - RNA, 22 nt, Artificial Sequence
  Synthetic construct: hsa-miR-6827
ugggagccaugagggucugugc

SEQ ID NO: 3093 - RNA, 21 nt, Artificial Sequence
  Synthetic construct: hsa-miR-6827
accgucucuucuguuccccag

SEQ ID NO: 3094 - RNA, 20 nt, Artificial Sequence
  Synthetic construct: hsa-miR-6828
aucugcucucuuguucccag

SEQ ID NO: 3095 - RNA, 22 nt, Artificial Sequence
  Synthetic construct: hsa-miR-6828
aggaagcaagagaacccugugg

SEQ ID NO: 3096 - RNA, 20 nt, Artificial Sequence
  Synthetic construct: hsa-miR-6829
ugggcugcugagaaggggca

SEQ ID NO: 3097 - RNA, 20 nt, Artificial Sequence
  Synthetic construct: hsa-miR-6829
ugccuccuccguggccucag

SEQ ID NO: 3098 - RNA, 22 nt, Artificial Sequence
  Synthetic construct: hsa-miR-6830
ccaaggaaggaggcuggacauc

SEQ ID NO: 3099 - RNA, 23 nt, Artificial Sequence
  Synthetic construct: hsa-miR-6830
ugucuuucuucucucccuugcag

SEQ ID NO: 3100 - RNA, 24 nt, Artificial Sequence
  Synthetic construct: hsa-miR-6831
uagguagagugugaggaggagguc

SEQ ID NO: 3101 - RNA, 21 nt, Artificial Sequence
  Synthetic construct: hsa-miR-6831
ugacuaacucccacucuacag

SEQ ID NO: 3102 - RNA, 23 nt, Artificial Sequence
  Synthetic construct: hsa-miR-6832
aguagagaggaaaaguuaggguc

SEQ ID NO: 3103 - RNA, 20 nt, Artificial Sequence
  Synthetic construct: hsa-miR-6832
acccuuuuucucuuucccag

SEQ ID NO: 3104 - RNA, 21 nt, Artificial Sequence
  Synthetic construct: hsa-miR-6833
uuucucucuccacuuccucag

SEQ ID NO: 3105 - RNA, 22 nt, Artificial Sequence
  Synthetic construct: hsa-miR-6833
guguggaagaugggaggagaaa

SEQ ID NO: 3106 - RNA, 21 nt, Artificial Sequence
  Synthetic construct: hsa-miR-6834
gugagggacugggauuugugg

SEQ ID NO: 3107 - RNA, 20 nt, Artificial Sequence
  Synthetic construct: hsa-miR-6834
uaugucccaucccuccauca

SEQ ID NO: 3108 - RNA, 22 nt, Artificial Sequence
  Synthetic construct: hsa-miR-6835
aggggguagaaaguggcugaag

SEQ ID NO: 3109 - RNA, 23 nt, Artificial Sequence
  Synthetic construct: hsa-miR-6835
aaaagcacuuuucugucucccag

SEQ ID NO: 3110 - RNA, 21 nt, Artificial Sequence
  Synthetic construct: hsa-miR-6836
augccucccccggccccgcag

SEQ ID NO: 3111 - RNA, 22 nt, Artificial Sequence
  Synthetic construct: hsa-miR-6836
cgcagggcccuggcgcaggcau

SEQ ID NO: 3112 - RNA, 21 nt, Artificial Sequence
  Synthetic construct: hsa-miR-6837
accagggccagcagggaaugu

SEQ ID NO: 3113 - RNA, 23 nt, Artificial Sequence
  Synthetic construct: hsa-miR-6837
ccuucacugugacucugcugcag

SEQ ID NO: 3114 - RNA, 22 nt, Artificial Sequence
  Synthetic construct: hsa-miR-6838
aagcagcaguggcaagacuccu

SEQ ID NO: 3115 - RNA, 20 nt, Artificial Sequence
  Synthetic construct: hsa-miR-6838
aaguccugcuucuguugcag

SEQ ID NO: 3116 - RNA, 22 nt, Artificial Sequence
  Synthetic construct: hsa-miR-6839
ucuggauugaagagacgaccca

SEQ ID NO: 3117 - RNA, 22 nt, Artificial Sequence
  Synthetic construct: hsa-miR-6839
uuggguuuucucuucaauccag

SEQ ID NO: 3118 - RNA, 24 nt, Artificial Sequence
  Synthetic construct: hsa-miR-6840
acccccgggcaaagaccugcagau

SEQ ID NO: 3119 - RNA, 22 nt, Artificial Sequence
  Synthetic construct: hsa-miR-6840
gcccaggacuuugugcggggug

SEQ ID NO: 3120 - RNA, 22 nt, Artificial Sequence
  Synthetic construct: hsa-miR-6841
uaggguacucagagcaaguugu

SEQ ID NO: 3121 - RNA, 21 nt, Artificial Sequence
  Synthetic construct: hsa-miR-6841
accuugcaucugcauccccag

SEQ ID NO: 3122 - RNA, 22 nt, Artificial Sequence
  Synthetic construct: hsa-miR-6842
uggggguggucucuagccaagg

SEQ ID NO: 3123 - RNA, 22 nt, Artificial Sequence
  Synthetic construct: hsa-miR-6842
uuggcuggucucugcuccgcag

SEQ ID NO: 3124 - RNA, 21 nt, Artificial Sequence
  Synthetic construct: hsa-miR-6843
auggucuccuguucucugcag

SEQ ID NO: 3125 - RNA, 21 nt, Artificial Sequence
  Synthetic construct: hsa-miR-6843
gcagagaacaggagaccauuu

SEQ ID NO: 3126 - RNA, 21 nt, Artificial Sequence
  Synthetic construct: hsa-miR-6844
uucuuuguuuuuaauucacag

SEQ ID NO: 3127 - RNA, 21 nt, Artificial Sequence
  Synthetic construct: hsa-miR-6844
gugaauuaaaaacaaagaauu

SEQ ID NO: 3128 - RNA, 19 nt, Artificial Sequence
  Synthetic construct: hsa-miR-6845
cggggccagagcagagagc

SEQ ID NO: 3129 - RNA, 21 nt, Artificial Sequence
  Synthetic construct: hsa-miR-6845
ccucuccucccugugccccag

SEQ ID NO: 3130 - RNA, 21 nt, Artificial Sequence
  Synthetic construct: hsa-miR-6846
ugaccccuucugucucccuag

SEQ ID NO: 3131 - RNA, 22 nt, Artificial Sequence
  Synthetic construct: hsa-miR-6846
ugggggcuggaugggguagagu

SEQ ID NO: 3132 - RNA, 22 nt, Artificial Sequence
  Synthetic construct: hsa-miR-6847
ggcucaugugucuguccucuuc

SEQ ID NO: 3133 - RNA, 23 nt, Artificial Sequence
  Synthetic construct: hsa-miR-6847
acagaggacaguggagugugagc

SEQ ID NO: 3134 - RNA, 23 nt, Artificial Sequence
  Synthetic construct: hsa-miR-6848
ugggggcugggaugggccauggu

SEQ ID NO: 3135 - RNA, 19 nt, Artificial Sequence
  Synthetic construct: hsa-miR-6848
guggucucuuggcccccag

SEQ ID NO: 3136 - RNA, 22 nt, Artificial Sequence
  Synthetic construct: hsa-miR-6849
accagccuguguccaccuccag

SEQ ID NO: 3137 - RNA, 23 nt, Artificial Sequence
  Synthetic construct: hsa-miR-6849
gaguggauaggggagugugugga

SEQ ID NO: 3138 - RNA, 20 nt, Artificial Sequence
  Synthetic construct: hsa-miR-6850
cccggccggaacgccgcacu

SEQ ID NO: 3139 - RNA, 22 nt, Artificial Sequence
  Synthetic construct: hsa-miR-6850
gugcggaacgcuggccggggcg

SEQ ID NO: 3140 - RNA, 23 nt, Artificial Sequence
  Synthetic construct: hsa-miR-6851
aggaggugguacuaggggccagc

SEQ ID NO: 3141 - RNA, 21 nt, Artificial Sequence
  Synthetic construct: hsa-miR-6851
uggcccuuuguaccccuccag

SEQ ID NO: 3142 - RNA, 21 nt, Artificial Sequence
  Synthetic construct: hsa-miR-6852
cccugggguucugaggacaug

SEQ ID NO: 3143 - RNA, 17 nt, Artificial Sequence
  Synthetic construct: hsa-miR-6852
uguccucuguuccucag

SEQ ID NO: 3144 - RNA, 24 nt, Artificial Sequence
  Synthetic construct: hsa-miR-6853
agcgugggauguccaugaagucag

SEQ ID NO: 3145 - RNA, 22 nt, Artificial Sequence
  Synthetic construct: hsa-miR-6853
uguucauuggaacccugcgcag

SEQ ID NO: 3146 - RNA, 21 nt, Artificial Sequence
  Synthetic construct: hsa-miR-6854
ugcguuucuccucuugagcag

SEQ ID NO: 3147 - RNA, 24 nt, Artificial Sequence
  Synthetic construct: hsa-miR-6854
aagcucagguuugagaacugcuga

SEQ ID NO: 3148 - RNA, 22 nt, Artificial Sequence
  Synthetic construct: hsa-miR-6855
agacugaccuucaaccccacag

SEQ ID NO: 3149 - RNA, 25 nt, Artificial Sequence
  Synthetic construct: hsa-miR-6855
uugggguuuggggugcagacauugc

SEQ ID NO: 3150 - RNA, 22 nt, Artificial Sequence
  Synthetic construct: hsa-miR-6856
uacagcccugugaucuuuccag

SEQ ID NO: 3151 - RNA, 24 nt, Artificial Sequence
  Synthetic construct: hsa-miR-6856
aagagaggagcaguggugcugugg

SEQ ID NO: 3152 - RNA, 21 nt, Artificial Sequence
  Synthetic construct: hsa-miR-6857
ugacugagcuucuccccacag

SEQ ID NO: 3153 - RNA, 22 nt, Artificial Sequence
  Synthetic construct: hsa-miR-6857
uuggggauugggucaggccagu

SEQ ID NO: 3154 - RNA, 22 nt, Artificial Sequence
  Synthetic construct: hsa-miR-6858
cagccagccccugcucaccccu

SEQ ID NO: 3155 - RNA, 22 nt, Artificial Sequence
  Synthetic construct: hsa-miR-6858
gugaggaggggcuggcagggac

SEQ ID NO: 3156 - RNA, 23 nt, Artificial Sequence
  Synthetic construct: hsa-miR-6859
ugacccccaugucgccucuguag

SEQ ID NO: 3157 - RNA, 23 nt, Artificial Sequence
  Synthetic construct: hsa-miR-6859
gagaggaacaugggcucaggaca

SEQ ID NO: 3158 - RNA, 22 nt, Artificial Sequence
  Synthetic construct: hsa-miR-6860
acugggcagggcuguggugagu

SEQ ID NO: 3159 - RNA, 22 nt, Artificial Sequence
  Synthetic construct: hsa-miR-6860
ucaccacagcccugcccaguuu

SEQ ID NO: 3160 - RNA, 22 nt, Artificial Sequence
  Synthetic construct: hsa-miR-6861
acuggguagguggggcuccagg

SEQ ID NO: 3161 - RNA, 18 nt, Artificial Sequence
  Synthetic construct: hsa-miR-6861
uggaccucuccuccccag

SEQ ID NO: 3162 - RNA, 24 nt, Artificial Sequence
  Synthetic construct: hsa-miR-6862
ccucacccagcucucuggcccucu

SEQ ID NO: 3163 - RNA, 22 nt, Artificial Sequence
  Synthetic construct: hsa-miR-6862
cgggcaugcugggagagacuuu

SEQ ID NO: 3164 - RNA, 23 nt, Artificial Sequence
  Synthetic construct: hsa-miR-6863
uagacguggugaaggauugagug

SEQ ID NO: 3165 - RNA, 23 nt, Artificial Sequence
  Synthetic construct: hsa-miR-6863
cucaauccuucaccacgucuauu

SEQ ID NO: 3166 - RNA, 24 nt, Artificial Sequence
  Synthetic construct: hsa-miR-6864
uugaagggacaagucagauaugcc

SEQ ID NO: 3167 - RNA, 21 nt, Artificial Sequence
  Synthetic construct: hsa-miR-6864
gugagacuucucucccuucag

SEQ ID NO: 3168 - RNA, 21 nt, Artificial Sequence
  Synthetic construct: hsa-miR-6865
acacccucuuucccuaccgcc

SEQ ID NO: 3169 - RNA, 23 nt, Artificial Sequence
  Synthetic construct: hsa-miR-6865
uagguggcagaggagggacuuca

SEQ ID NO: 3170 - RNA, 22 nt, Artificial Sequence
  Synthetic construct: hsa-miR-6866
gaucccuuuaucuguccucuag

SEQ ID NO: 3171 - RNA, 23 nt, Artificial Sequence
  Synthetic construct: hsa-miR-6866
uuagaggcuggaauagagauucu

SEQ ID NO: 3172 - RNA, 23 nt, Artificial Sequence
  Synthetic construct: hsa-miR-6867
uguguguguagaggaagaaggga

SEQ ID NO: 3173 - RNA, 21 nt, Artificial Sequence
  Synthetic construct: hsa-miR-6867
cucucccucuuuacccacuag

SEQ ID NO: 3174 - RNA, 22 nt, Artificial Sequence
  Synthetic construct: hsa-miR-6868
acuggcagaacacugaagcagc

SEQ ID NO: 3175 - RNA, 21 nt, Artificial Sequence
  Synthetic construct: hsa-miR-6868
uuccuucuguugucugugcag

SEQ ID NO: 3176 - RNA, 22 nt, Artificial Sequence
  Synthetic construct: hsa-miR-6869
gugaguaguggcgcgcggcggc

SEQ ID NO: 3177 - RNA, 21 nt, Artificial Sequence
  Synthetic construct: hsa-miR-6869
cgccgcgcgcaucggcucagc

SEQ ID NO: 3178 - RNA, 19 nt, Artificial Sequence
  Synthetic construct: hsa-miR-6870
ugggggagauggggguuga

SEQ ID NO: 3179 - RNA, 22 nt, Artificial Sequence
  Synthetic construct: hsa-miR-6870
gcucauccccaucuccuuucag

SEQ ID NO: 3180 - RNA, 22 nt, Artificial Sequence
  Synthetic construct: hsa-miR-6871
caugggaguucggggugguugc

SEQ ID NO: 3181 - RNA, 22 nt, Artificial Sequence
  Synthetic construct: hsa-miR-6871
cagcacccuguggcucccacag

SEQ ID NO: 3182 - RNA, 21 nt, Artificial Sequence
  Synthetic construct: hsa-miR-6872
cccaugccuccugccgcgguc

SEQ ID NO: 3183 - RNA, 20 nt, Artificial Sequence
  Synthetic construct: hsa-miR-6872
ucucgcaucaggaggcaagg

SEQ ID NO: 3184 - RNA, 23 nt, Artificial Sequence
  Synthetic construct: hsa-miR-6873
uucucucugucuuucucucucag

SEQ ID NO: 3185 - RNA, 22 nt, Artificial Sequence
  Synthetic construct: hsa-miR-6873
cagagggaauacagagggcaau

SEQ ID NO: 3186 - RNA, 23 nt, Artificial Sequence
  Synthetic construct: hsa-miR-6874
auggagcuggaaccagaucaggc

SEQ ID NO: 3187 - RNA, 23 nt, Artificial Sequence
  Synthetic construct: hsa-miR-6874
caguucugcuguucugacucuag

SEQ ID NO: 3188 - RNA, 21 nt, Artificial Sequence
  Synthetic construct: hsa-miR-6875
ugagggacccaggacaggaga

SEQ ID NO: 3189 - RNA, 22 nt, Artificial Sequence
  Synthetic construct: hsa-miR-6875
auucuuccugcccuggcuccau

SEQ ID NO: 3190 - RNA, 24 nt, Artificial Sequence
  Synthetic construct: hsa-miR-6876
agcugucuguguuuuccuucucag

SEQ ID NO: 3191 - RNA, 22 nt, Artificial Sequence
  Synthetic construct: hsa-miR-6876
caggaaggagacaggcaguuca

SEQ ID NO: 3192 - RNA, 21 nt, Artificial Sequence
  Synthetic construct: hsa-miR-6877
cagccucugcccuuggccucc

SEQ ID NO: 3193 - RNA, 22 nt, Artificial Sequence
  Synthetic construct: hsa-miR-6877
agggccgaaggguggaagcugc

SEQ ID NO: 3194 - RNA, 21 nt, Artificial Sequence
  Synthetic construct: hsa-miR-6878
cuggccucuucuuucuccuag

SEQ ID NO: 3195 - RNA, 23 nt, Artificial Sequence
  Synthetic construct: hsa-miR-6878
agggagaaagcuagaagcugaag

SEQ ID NO: 3196 - RNA, 21 nt, Artificial Sequence
  Synthetic construct: hsa-miR-6879
ugucacccgcuccuugcccag

SEQ ID NO: 3197 - RNA, 22 nt, Artificial Sequence
  Synthetic construct: hsa-miR-6879
cagggcagggaaggugggagag

SEQ ID NO: 3198 - RNA, 22 nt, Artificial Sequence
  Synthetic construct: hsa-miR-6880
ugguggaggaagagggcagcuc

SEQ ID NO: 3199 - RNA, 21 nt, Artificial Sequence
  Synthetic construct: hsa-miR-6880
ccgccuucucuccucccccag

SEQ ID NO: 3200 - RNA, 22 nt, Artificial Sequence
  Synthetic construct: hsa-miR-6881
auccucuuucguccuucccacu

SEQ ID NO: 3201 - RNA, 22 nt, Artificial Sequence
  Synthetic construct: hsa-miR-6881
ugggguaaggauaggaggguca

SEQ ID NO: 3202 - RNA, 24 nt, Artificial Sequence
  Synthetic construct: hsa-miR-6882
ugcugccucuccucuugccugcag

SEQ ID NO: 3203 - RNA, 22 nt, Artificial Sequence
  Synthetic construct: hsa-miR-6882
uacaagucaggagcugaagcag

SEQ ID NO: 3204 - RNA, 22 nt, Artificial Sequence
  Synthetic construct: hsa-miR-6883
uucccuaucucacucuccucag

SEQ ID NO: 3205 - RNA, 22 nt, Artificial Sequence
  Synthetic construct: hsa-miR-6883
agggagggugugguauggaugu

SEQ ID NO: 3206 - RNA, 23 nt, Artificial Sequence
  Synthetic construct: hsa-miR-6884
cccaucaccuuuccgucuccccu

SEQ ID NO: 3207 - RNA, 22 nt, Artificial Sequence
  Synthetic construct: hsa-miR-6884
agaggcugagaaggugauguug

SEQ ID NO: 3208 - RNA, 25 nt, Artificial Sequence
  Synthetic construct: hsa-miR-6885
aggggggcacugcgcaagcaaagcc

SEQ ID NO: 3209 - RNA, 21 nt, Artificial Sequence
  Synthetic construct: hsa-miR-6885
cuuugcuuccugcuccccuag

SEQ ID NO: 3210 - RNA, 21 nt, Artificial Sequence
  Synthetic construct: hsa-miR-6886
ugcccuucucuccuccugccu

SEQ ID NO: 3211 - RNA, 21 nt, Artificial Sequence
  Synthetic construct: hsa-miR-6886
cccgcaggugagaugagggcu

SEQ ID NO: 3212 - RNA, 21 nt, Artificial Sequence
  Synthetic construct: hsa-miR-6887
uccccuccacuuuccuccuag

SEQ ID NO: 3213 - RNA, 23 nt, Artificial Sequence
  Synthetic construct: hsa-miR-6887
uggggggacagauggagaggaca

SEQ ID NO: 3214 - RNA, 20 nt, Artificial Sequence
  Synthetic construct: hsa-miR-6888
aaggagaugcucaggcagau

SEQ ID NO: 3215 - RNA, 21 nt, Artificial Sequence
  Synthetic construct: hsa-miR-6888
aucugucucgauuguuuccag

SEQ ID NO: 3216 - RNA, 23 nt, Artificial Sequence
  Synthetic construct: hsa-miR-6889
ucggggagucugggguccggaau

SEQ ID NO: 3217 - RNA, 20 nt, Artificial Sequence
  Synthetic construct: hsa-miR-6889
ucugugccccuacuucccag

SEQ ID NO: 3218 - RNA, 20 nt, Artificial Sequence
  Synthetic construct: hsa-miR-6890
ccacugccuaugccccacag

SEQ ID NO: 3219 - RNA, 21 nt, Artificial Sequence
  Synthetic construct: hsa-miR-6890
caugggguagggcagaguagg

SEQ ID NO: 3220 - RNA, 21 nt, Artificial Sequence
  Synthetic construct: hsa-miR-6891
cccucaucuuccccuccuuuc

SEQ ID NO: 3221 - RNA, 19 nt, Artificial Sequence
  Synthetic construct: hsa-miR-6891
uaaggagggggaugagggg

SEQ ID NO: 3222 - RNA, 21 nt, Artificial Sequence
  Synthetic construct: hsa-miR-6892
guaagggaccggagaguagga

SEQ ID NO: 3223 - RNA, 21 nt, Artificial Sequence
  Synthetic construct: hsa-miR-6892
ucccucucccaccccuugcag

SEQ ID NO: 3224 - RNA, 22 nt, Artificial Sequence
  Synthetic construct: hsa-miR-6893
cccugcugccuucaccugccag

SEQ ID NO: 3225 - RNA, 21 nt, Artificial Sequence
  Synthetic construct: hsa-miR-6893
caggcagguguaggguggagc

SEQ ID NO: 3226 - RNA, 21 nt, Artificial Sequence
  Synthetic construct: hsa-miR-6894
uugccugcccucuuccuccag

SEQ ID NO: 3227 - RNA, 24 nt, Artificial Sequence
  Synthetic construct: hsa-miR-6894
aggaggauggagagcugggccaga

SEQ ID NO: 3228 - RNA, 21 nt, Artificial Sequence
  Synthetic construct: hsa-miR-6895
cagggccaggcacagaguaag

SEQ ID NO: 3229 - RNA, 22 nt, Artificial Sequence
  Synthetic construct: hsa-miR-6895
ugucucucgcccuuggccuuag

SEQ ID NO: 3230 - RNA, 23 nt, Artificial Sequence
  Synthetic construct: hsa-miR-7-1
uggaagacuagugauuuuguugu

SEQ ID NO: 3231 - RNA, 22 nt, Artificial Sequence
  Synthetic construct: hsa-miR-7-1
caacaaaucacagucugccaua

SEQ ID NO: 3232 - RNA, 23 nt, Artificial Sequence
  Synthetic construct: hsa-miR-7-2
uggaagacuagugauuuuguugu

SEQ ID NO: 3233 - RNA, 22 nt, Artificial Sequence
  Synthetic construct: hsa-miR-7-2
caacaaaucccagucuaccuaa

SEQ ID NO: 3234 - RNA, 22 nt, Artificial Sequence
  Synthetic construct: hsa-miR-708
caacuagacugugagcuucuag

SEQ ID NO: 3235 - RNA, 23 nt, Artificial Sequence
  Synthetic construct: hsa-miR-708
aaggagcuuacaaucuagcuggg

SEQ ID NO: 3236 - RNA, 20 nt, Artificial Sequence
  Synthetic construct: hsa-miR-7106
ugggaggaggggaucuuggg

SEQ ID NO: 3237 - RNA, 23 nt, Artificial Sequence
  Synthetic construct: hsa-miR-7106
agcucccugaaucccugucccag

SEQ ID NO: 3238 - RNA, 22 nt, Artificial Sequence
  Synthetic construct: hsa-miR-7107
ucggccuggggaggaggaaggg

SEQ ID NO: 3239 - RNA, 27 nt, Artificial Sequence
  Synthetic construct: hsa-miR-7107
uggucuguucauucucucuuuuuggcc

SEQ ID NO: 3240 - RNA, 21 nt, Artificial Sequence
  Synthetic construct: hsa-miR-7108
guguggccggcaggcgggugg

SEQ ID NO: 3241 - RNA, 20 nt, Artificial Sequence
  Synthetic construct: hsa-miR-7108
acccgcccgucuccccacag

SEQ ID NO: 3242 - RNA, 22 nt, Artificial Sequence
  Synthetic construct: hsa-miR-7109
caagccucuccugcccuuccag

SEQ ID NO: 3243 - RNA, 21 nt, Artificial Sequence
  Synthetic construct: hsa-miR-7109
cuggggggaggagacccugcu

SEQ ID NO: 3244 - RNA, 22 nt, Artificial Sequence
  Synthetic construct: hsa-miR-711
gggacccagggagagacguaag

SEQ ID NO: 3245 - RNA, 22 nt, Artificial Sequence
  Synthetic construct: hsa-miR-711
uacgucucucccugggucccuu

SEQ ID NO: 3246 - RNA, 22 nt, Artificial Sequence
  Synthetic construct: hsa-miR-7110
ucucucucccacuucccugcag

SEQ ID NO: 3247 - RNA, 21 nt, Artificial Sequence
  Synthetic construct: hsa-miR-7110
uggggguguggggagagagag

SEQ ID NO: 3248 - RNA, 22 nt, Artificial Sequence
  Synthetic construct: hsa-miR-7111
auccucucuucccuccucccag

SEQ ID NO: 3249 - RNA, 22 nt, Artificial Sequence
  Synthetic construct: hsa-miR-7111
ugggggaggaaggacaggccau

SEQ ID NO: 3250 - RNA, 23 nt, Artificial Sequence
  Synthetic construct: hsa-miR-7112
ugcaucacagccuuuggcccuag

SEQ ID NO: 3251 - RNA, 22 nt, Artificial Sequence
  Synthetic construct: hsa-miR-7112
acgggcagggcagugcacccug

SEQ ID NO: 3252 - RNA, 21 nt, Artificial Sequence
  Synthetic construct: hsa-miR-7113
uccagggagacagugugugag

SEQ ID NO: 3253 - RNA, 23 nt, Artificial Sequence
  Synthetic construct: hsa-miR-7113
ccucccugcccgccucucugcag

SEQ ID NO: 3254 - RNA, 21 nt, Artificial Sequence
  Synthetic construct: hsa-miR-7114
ugacccaccccucuccaccag

SEQ ID NO: 3255 - RNA, 21 nt, Artificial Sequence
  Synthetic construct: hsa-miR-7114
ucuguggaguggggugccugu

SEQ ID NO: 3256 - RNA, 18 nt, Artificial Sequence
  Synthetic construct: hsa-miR-7150
cuggcagggggagaggua

SEQ ID NO: 3257 - RNA, 18 nt, Artificial Sequence
  Synthetic construct: hsa-miR-7150
ccucucccccugccaguu

SEQ ID NO: 3258 - RNA, 23 nt, Artificial Sequence
  Synthetic construct: hsa-miR-7151
gauccaucucugccuguauuggc

SEQ ID NO: 3259 - RNA, 21 nt, Artificial Sequence
  Synthetic construct: hsa-miR-7151
cuacaggcuggaaugggcuca

SEQ ID NO: 3260 - RNA, 20 nt, Artificial Sequence
  Synthetic construct: hsa-miR-7152
ucugguccuggacaggaggc

SEQ ID NO: 3261 - RNA, 22 nt, Artificial Sequence
  Synthetic construct: hsa-miR-7152
uuuccuguccuccaaccagacc

SEQ ID NO: 3262 - RNA, 18 nt, Artificial Sequence
  Synthetic construct: hsa-miR-7153
caccauggacgguuuacc

SEQ ID NO: 3263 - RNA, 23 nt, Artificial Sequence
  Synthetic construct: hsa-miR-7153
ugagaacugacaaaugugguagg

SEQ ID NO: 3264 - RNA, 23 nt, Artificial Sequence
  Synthetic construct: hsa-miR-7154
uucaugaacugggucuagcuugg

SEQ ID NO: 3265 - RNA, 20 nt, Artificial Sequence
  Synthetic construct: hsa-miR-7154
aggaggacaaguugugggau

SEQ ID NO: 3266 - RNA, 19 nt, Artificial Sequence
  Synthetic construct: hsa-miR-7155
uggcccaagaccucagacc

SEQ ID NO: 3267 - RNA, 19 nt, Artificial Sequence
  Synthetic construct: hsa-miR-7155
ucuggggucuugggccauc

SEQ ID NO: 3268 - RNA, 23 nt, Artificial Sequence
  Synthetic construct: hsa-miR-7156
cugcagccacuuggggaacuggu

SEQ ID NO: 3269 - RNA, 23 nt, Artificial Sequence
  Synthetic construct: hsa-miR-7156
uuguucucaaacuggcugucaga

SEQ ID NO: 3270 - RNA, 22 nt, Artificial Sequence
  Synthetic construct: hsa-miR-7157
ucugugcuacuggaugaagagu

SEQ ID NO: 3271 - RNA, 23 nt, Artificial Sequence
  Synthetic construct: hsa-miR-7157
ucagcauucauuggcaccagaga

SEQ ID NO: 3272 - RNA, 24 nt, Artificial Sequence
  Synthetic construct: hsa-miR-7158
ggcucaaucucugguccugcagcc

SEQ ID NO: 3273 - RNA, 21 nt, Artificial Sequence
  Synthetic construct: hsa-miR-7158
cugaacuagagauugggccca

SEQ ID NO: 3274 - RNA, 19 nt, Artificial Sequence
  Synthetic construct: hsa-miR-7159
uuucuauguuaguuggaag

SEQ ID NO: 3275 - RNA, 21 nt, Artificial Sequence
  Synthetic construct: hsa-miR-7159
uucaacaaggguguaggaugg

SEQ ID NO: 3276 - RNA, 21 nt, Artificial Sequence
  Synthetic construct: hsa-miR-7160
cagggcccuggcuuuagcaga

SEQ ID NO: 3277 - RNA, 21 nt, Artificial Sequence
  Synthetic construct: hsa-miR-7160
ugcugagguccgggcugugcc

SEQ ID NO: 3278 - RNA, 23 nt, Artificial Sequence
  Synthetic construct: hsa-miR-7161
uaaagacuguagaggcaacuggu

SEQ ID NO: 3279 - RNA, 28 nt, Artificial Sequence
  Synthetic construct: hsa-miR-7161
uagaucuuugacucuggcagucuccagg

SEQ ID NO: 3280 - RNA, 19 nt, Artificial Sequence
  Synthetic construct: hsa-miR-7162
ucugagguggaacagcagc

SEQ ID NO: 3281 - RNA, 18 nt, Artificial Sequence
  Synthetic construct: hsa-miR-7162
ugcuuccuuucucagcug

SEQ ID NO: 3282 - RNA, 21 nt, Artificial Sequence
  Synthetic construct: hsa-miR-718
cuuccgccccgccgggcgucg

SEQ ID NO: 3283 - RNA, 21 nt, Artificial Sequence
  Synthetic construct: hsa-miR-718
acgcccggcggggcggaaguu

SEQ ID NO: 3284 - RNA, 22 nt, Artificial Sequence
  Synthetic construct: hsa-miR-744
ugcggggcuagggcuaacagca

SEQ ID NO: 3285 - RNA, 22 nt, Artificial Sequence
  Synthetic construct: hsa-miR-744
cuguugccacuaaccucaaccu

SEQ ID NO: 3286 - RNA, 18 nt, Artificial Sequence
  Synthetic construct: hsa-miR-7515
agaagggaagauggugac

SEQ ID NO: 3287 - RNA, 18 nt, Artificial Sequence
  Synthetic construct: hsa-miR-7515
caccaucuucccuucuuu

SEQ ID NO: 3288 - RNA, 22 nt, Artificial Sequence
  Synthetic construct: hsa-miR-758
uuugugaccugguccacuaacc

SEQ ID NO: 3289 - RNA, 22 nt, Artificial Sequence
  Synthetic construct: hsa-miR-758
gaugguugaccagagagcacac

SEQ ID NO: 3290 - RNA, 22 nt, Artificial Sequence
  Synthetic construct: hsa-miR-759
gcagagugcaaacaauuuugac

SEQ ID NO: 3291 - RNA, 22 nt, Artificial Sequence
  Synthetic construct: hsa-miR-759
caaaauuguuugcacucugcuu

SEQ ID NO: 3292 - RNA, 20 nt, Artificial Sequence
  Synthetic construct: hsa-miR-760
cggcucugggucugugggga

SEQ ID NO: 3293 - RNA, 20 nt, Artificial Sequence
  Synthetic construct: hsa-miR-760
cccacagacccagagccguu

SEQ ID NO: 3294 - RNA, 22 nt, Artificial Sequence
  Synthetic construct: hsa-miR-761
gcagcagggugaaacugacaca

SEQ ID NO: 3295 - RNA, 22 nt, Artificial Sequence
  Synthetic construct: hsa-miR-761
ugucaguuucacccugcugcuu

SEQ ID NO: 3296 - RNA, 22 nt, Artificial Sequence
  Synthetic construct: hsa-miR-762
ggggcuggggccggggccgagc

SEQ ID NO: 3297 - RNA, 22 nt, Artificial Sequence
  Synthetic construct: hsa-miR-762
ucggccccggccccagccccuu

SEQ ID NO: 3298 - RNA, 22 nt, Artificial Sequence
  Synthetic construct: hsa-miR-764
gcaggugcucacuuguccuccu

SEQ ID NO: 3299 - RNA, 22 nt, Artificial Sequence
  Synthetic construct: hsa-miR-764
gaggacaagugagcaccugcuu

SEQ ID NO: 3300 - RNA, 19 nt, Artificial Sequence
  Synthetic construct: hsa-miR-7641
uugaucucggaagcuaagc

SEQ ID NO: 3301 - RNA, 19 nt, Artificial Sequence
  Synthetic construct: hsa-miR-7641
uuagcuuccgagaucaauu

SEQ ID NO: 3302 - RNA, 21 nt, Artificial Sequence
  Synthetic construct: hsa-miR-765
uggaggagaaggaaggugaug

SEQ ID NO: 3303 - RNA, 21 nt, Artificial Sequence
  Synthetic construct: hsa-miR-765
ucaccuuccuucuccuccauu

SEQ ID NO: 3304 - RNA, 22 nt, Artificial Sequence
  Synthetic construct: hsa-miR-766
aggaggaauuggugcuggucuu

SEQ ID NO: 3305 - RNA, 22 nt, Artificial Sequence
  Synthetic construct: hsa-miR-766
acuccagccccacagccucagc

SEQ ID NO: 3306 - RNA, 23 nt, Artificial Sequence
  Synthetic construct: hsa-miR-767
ugcaccaugguugucugagcaug

SEQ ID NO: 3307 - RNA, 23 nt, Artificial Sequence
  Synthetic construct: hsa-miR-767
ucugcucauaccccaugguuucu

SEQ ID NO: 3308 - RNA, 23 nt, Artificial Sequence
  Synthetic construct: hsa-miR-769
cugggaucuccggggucuugguu

SEQ ID NO: 3309 - RNA, 22 nt, Artificial Sequence
  Synthetic construct: hsa-miR-769
ugagaccucuggguucugagcu

SEQ ID NO: 3310 - RNA, 23 nt, Artificial Sequence
  Synthetic construct: hsa-miR-770
uccaguaccacgugucagggcca

SEQ ID NO: 3311 - RNA, 23 nt, Artificial Sequence
  Synthetic construct: hsa-miR-770
gcccugacacgugguacuggauu

SEQ ID NO: 3312 - RNA, 22 nt, Artificial Sequence
  Synthetic construct: hsa-miR-7702
cuuagacugccagacucccuga

SEQ ID NO: 3313 - RNA, 22 nt, Artificial Sequence
  Synthetic construct: hsa-miR-7702
agggagucuggcagucuaaguu

SEQ ID NO: 3314 - RNA, 23 nt, Artificial Sequence
  Synthetic construct: hsa-miR-7703
uugcacucuggccuucucccagg

SEQ ID NO: 3315 - RNA, 23 nt, Artificial Sequence
  Synthetic construct: hsa-miR-7703
ugggagaaggccagagugcaauu

SEQ ID NO: 3316 - RNA, 19 nt, Artificial Sequence
  Synthetic construct: hsa-miR-7704
cggggucggcggcgacgug

SEQ ID NO: 3317 - RNA, 19 nt, Artificial Sequence
  Synthetic construct: hsa-miR-7704
cgucgccgccgaccccguu

SEQ ID NO: 3318 - RNA, 23 nt, Artificial Sequence
  Synthetic construct: hsa-miR-7705
aauagcucagaaugucaguucug

SEQ ID NO: 3319 - RNA, 23 nt, Artificial Sequence
  Synthetic construct: hsa-miR-7705
gaacugacauucugagcuauuuu

SEQ ID NO: 3320 - RNA, 24 nt, Artificial Sequence
  Synthetic construct: hsa-miR-7706
ugaagcgccugugcucugccgaga

SEQ ID NO: 3321 - RNA, 24 nt, Artificial Sequence
  Synthetic construct: hsa-miR-7706
ucggcagagcacaggcgcuucauu

SEQ ID NO: 3322 - RNA, 22 nt, Artificial Sequence
  Synthetic construct: hsa-miR-7843
augaagccuucucugccuuacg

SEQ ID NO: 3323 - RNA, 22 nt, Artificial Sequence
  Synthetic construct: hsa-miR-7843
gagggcagagccagcuuccuga

SEQ ID NO: 3324 - RNA, 22 nt, Artificial Sequence
  Synthetic construct: hsa-miR-7844
aaaacuaggacuguguggugua

SEQ ID NO: 3325 - RNA, 22 nt, Artificial Sequence
  Synthetic construct: hsa-miR-7844
caccacacaguccuaguuuuuu

SEQ ID NO: 3326 - RNA, 21 nt, Artificial Sequence
  Synthetic construct: hsa-miR-7845
aagggacagggagggucgugg

SEQ ID NO: 3327 - RNA, 21 nt, Artificial Sequence
  Synthetic construct: hsa-miR-7845
acgacccucccugucccuuuu

SEQ ID NO: 3328 - RNA, 21 nt, Artificial Sequence
  Synthetic construct: hsa-miR-7846
cagcggagccuggagagaagg

SEQ ID NO: 3329 - RNA, 21 nt, Artificial Sequence
  Synthetic construct:
uucucuccaggcuccgcuguu

SEQ ID NO: 3330 - RNA, 21 nt, Artificial Sequence
  Synthetic construct: hsa-miR-7847
cguggaggacgaggaggaggc

SEQ ID NO: 3331 - RNA, 21 nt, Artificial Sequence
  Synthetic construct: hsa-miR-7847
cuccuccucguccuccacguu

SEQ ID NO: 3332 - RNA, 23 nt, Artificial Sequence
  Synthetic construct: hsa-miR-7848
cuacccucggucugcuuaccaca

SEQ ID NO: 3333 - RNA, 23 nt, Artificial Sequence
  Synthetic construct: hsa-miR-7848
ugguaagcagaccgaggguaguu

SEQ ID NO: 3334 - RNA, 22 nt, Artificial Sequence
  Synthetic construct: hsa-miR-7849
gacaauuguugaucuugggccu

SEQ ID NO: 3335 - RNA, 22 nt, Artificial Sequence
  Synthetic construct: hsa-miR-7849
gcccaagaucaacaauugucuu

SEQ ID NO: 3336 - RNA, 21 nt, Artificial Sequence
  Synthetic construct: hsa-miR-7850
guuuggacauaguguggcugg

SEQ ID NO: 3337 - RNA, 21 nt, Artificial Sequence
  Synthetic construct: hsa-miR-7850
agccacacuauguccaaacuu

SEQ ID NO: 3338 - RNA, 22 nt, Artificial Sequence
  Synthetic construct: hsa-miR-7851
uaccugggagacugagguugga

SEQ ID NO: 3339 - RNA, 22 nt, Artificial Sequence
  Synthetic construct: hsa-miR-7851
caaccucagucucccagguauu

SEQ ID NO: 3340 - RNA, 22 nt, Artificial Sequence
  Synthetic construct: hsa-miR-7852
uauguaguagucaaaggcauuu

SEQ ID NO: 3341 - RNA, 22 nt, Artificial Sequence
  Synthetic construct: hsa-miR-7852
augccuuugacuacuacauauu

SEQ ID NO: 3342 - RNA, 21 nt, Artificial Sequence
  Synthetic construct: hsa-miR-7853
ucaaaugcagauccugacuuc

SEQ ID NO: 3343 - RNA, 21 nt, Artificial Sequence
  Synthetic construct: hsa-miR-7853
agucaggaucugcauuugauu

SEQ ID NO: 3344 - RNA, 21 nt, Artificial Sequence
  Synthetic construct: hsa-miR-7854
ugaggugaccgcagaugggaa

SEQ ID NO: 3345 - RNA, 21 nt, Artificial Sequence
  Synthetic construct: hsa-miR-7854
cccaucugcggucaccucauu

SEQ ID NO: 3346 - RNA, 22 nt, Artificial Sequence
  Synthetic construct: hsa-miR-7855
uuggugaggaccccaagcucgg

SEQ ID NO: 3347 - RNA, 22 nt, Artificial Sequence
  Synthetic construct: hsa-miR-7855
gagcuugggguccucaccaauu

SEQ ID NO: 3348 - RNA, 21 nt, Artificial Sequence
  Synthetic construct: hsa-miR-7856
uuuuaaggacacugagggauc

SEQ ID NO: 3349 - RNA, 21 nt, Artificial Sequence
  Synthetic construct: hsa-miR-7856
ucccucaguguccuuaaaauu

SEQ ID NO: 3350 - RNA, 20 nt, Artificial Sequence
  Synthetic construct: hsa-miR-7973
ugugacccuagaauaauuac

SEQ ID NO: 3351 - RNA, 20 nt, Artificial Sequence
  Synthetic construct: hsa-miR-7973
aauuauucuagggucacauu

SEQ ID NO: 3352 - RNA, 24 nt, Artificial Sequence
  Synthetic construct: hsa-miR-7974
aggcugugaugcucuccugagccc

SEQ ID NO: 3353 - RNA, 24 nt, Artificial Sequence
  Synthetic construct: hsa-miR-7974
gcucaggagagcaucacagccuuu

SEQ ID NO: 3354 - RNA, 18 nt, Artificial Sequence
  Synthetic construct: hsa-miR-7975
auccuagucacggcacca

SEQ ID NO: 3355 - RNA, 18 nt, Artificial Sequence
  Synthetic construct: hsa-miR-7975
gugccgugacuaggauuu

SEQ ID NO: 3356 - RNA, 19 nt, Artificial Sequence
  Synthetic construct: hsa-miR-7976
ugcccugagacuuuugcuc

SEQ ID NO: 3357 - RNA, 19 nt, Artificial Sequence
  Synthetic construct: hsa-miR-7976
gcaaaagucucagggcauu

SEQ ID NO: 3358 - RNA, 18 nt, Artificial Sequence
  Synthetic construct: hsa-miR-7977
uucccagccaacgcacca

SEQ ID NO: 3359 - RNA, 18 nt, Artificial Sequence
  Synthetic construct: hsa-miR-7977
gugcguuggcugggaauu

SEQ ID NO: 3360 - RNA, 21 nt, Artificial Sequence
  Synthetic construct: hsa-miR-7978
ucugguguauagcguugcuca

SEQ ID NO: 3361 - RNA, 21 nt, Artificial Sequence
  Synthetic construct: hsa-miR-7978
agcaacgcuauacaccagauu

SEQ ID NO: 3362 - RNA, 23 nt, Artificial Sequence
  Synthetic construct: hsa-miR-802
caguaacaaagauucauccuugu

SEQ ID NO: 3363 - RNA, 23 nt, Artificial Sequence
  Synthetic construct: hsa-miR-802
aaggaugaaucuuuguuacuguu

SEQ ID NO: 3364 - RNA, 22 nt, Artificial Sequence
  Synthetic construct: hsa-miR-8052
cgggacuguagagggcaugagc

SEQ ID NO: 3365 - RNA, 22 nt, Artificial Sequence
  Synthetic construct: hsa-miR-8052
ucaugcccucuacagucccguu

SEQ ID NO: 3366 - RNA, 24 nt, Artificial Sequence
  Synthetic construct: hsa-miR-8053
uggcgauuuuggaacucaauggca

SEQ ID NO: 3367 - RNA, 24 nt, Artificial Sequence
  Synthetic construct: hsa-miR-8053
ccauugaguuccaaaaucgccauu

SEQ ID NO: 3368 - RNA, 21 nt, Artificial Sequence
  Synthetic construct: hsa-miR-8054
gaaaguacagaucggaugggu

SEQ ID NO: 3369 - RNA, 21 nt, Artificial Sequence
  Synthetic construct: hsa-miR-8054
ccauccgaucuguacuuucuu

SEQ ID NO: 3370 - RNA, 23 nt, Artificial Sequence
  Synthetic construct: hsa-miR-8055
cuuugagcacaugagcagacgga

SEQ ID NO: 3371 - RNA, 23 nt, Artificial Sequence
  Synthetic construct: hsa-miR-8055
cgucugcucaugugcucaaaguu

SEQ ID NO: 3372 - RNA, 20 nt, Artificial Sequence
  Synthetic construct: hsa-miR-8056
cguggauugucuggaugcau

SEQ ID NO: 3373 - RNA, 20 nt, Artificial Sequence
  Synthetic construct: hsa-miR-8056
gcauccagacaauccacguu

SEQ ID NO: 3374 - RNA, 21 nt, Artificial Sequence
  Synthetic construct: hsa-miR-8057
guggcucuguaguaagaugga

SEQ ID NO: 3375 - RNA, 21 nt, Artificial Sequence
  Synthetic construct: hsa-miR-8057
caucuuacuacagagccacuu

SEQ ID NO: 3376 - RNA, 22 nt, Artificial Sequence
  Synthetic construct: hsa-miR-8058
cuggacuuugaucuugccauaa

SEQ ID NO: 3377 - RNA, 22 nt, Artificial Sequence
  Synthetic construct: hsa-miR-8058
auggcaagaucaaaguccaguu

SEQ ID NO: 3378 - RNA, 22 nt, Artificial Sequence
  Synthetic construct: hsa-miR-8059
ggggaacuguagaugaaaaggc

SEQ ID NO: 3379 - RNA, 22 nt, Artificial Sequence
  Synthetic construct: hsa-miR-8059
cuuuucaucuacaguuccccuu

SEQ ID NO: 3380 - RNA, 24 nt, Artificial Sequence
  Synthetic construct: hsa-miR-8060
ccaugaagcaguggguaggaggac

SEQ ID NO: 3381 - RNA, 24 nt, Artificial Sequence
  Synthetic construct: hsa-miR-8060
ccuccuacccacugcuucaugguu

SEQ ID NO: 3382 - RNA, 21 nt, Artificial Sequence
  Synthetic construct: hsa-miR-8061
cuuagauuagaggauauuguu

SEQ ID NO: 3383 - RNA, 21 nt, Artificial Sequence
  Synthetic construct: hsa-miR-8061
caauauccucuaaucuaaguu

SEQ ID NO: 3384 - RNA, 21 nt, Artificial Sequence
  Synthetic construct: hsa-miR-8062
cagugauuugaggauuauugc

SEQ ID NO: 3385 - RNA, 21 nt, Artificial Sequence
  Synthetic construct: hsa-miR-8062
aauaauccucaaaucacuguu

SEQ ID NO: 3386 - RNA, 22 nt, Artificial Sequence
  Synthetic construct: hsa-miR-8063
ucaaaaucaggagucggggcuu

SEQ ID NO: 3387 - RNA, 22 nt, Artificial Sequence
  Synthetic construct: hsa-miR-8063
gccccgacuccugauuuugauu

SEQ ID NO: 3388 - RNA, 20 nt, Artificial Sequence
  Synthetic construct: hsa-miR-8064
agcacacugagcgagcggac

SEQ ID NO: 3389 - RNA, 20 nt, Artificial Sequence
  Synthetic construct: hsa-miR-8064
ccgcucgcucagugugcuuu

SEQ ID NO: 3390 - RNA, 24 nt, Artificial Sequence
  Synthetic construct: hsa-miR-8065
uguaggaacaguugaauuuuggcu

SEQ ID NO: 3391 - RNA, 24 nt, Artificial Sequence
  Synthetic construct: hsa-miR-8065
ccaaaauucaacuguuccuacauu

SEQ ID NO: 3392 - RNA, 21 nt, Artificial Sequence
  Synthetic construct: hsa-miR-8066
caaugugaucuuuuggaugua

SEQ ID NO: 3393 - RNA, 21 nt, Artificial Sequence
  Synthetic construct: hsa-miR-8066
cauccaaaagaucacauuguu

SEQ ID NO: 3394 - RNA, 22 nt, Artificial Sequence
  Synthetic construct: hsa-miR-8067
ccuagaaacuguaaacuuaguc

SEQ ID NO: 3395 - RNA, 22 nt, Artificial Sequence
  Synthetic construct: hsa-miR-8067
cuaaguuuacaguuucuagguu

SEQ ID NO: 3396 - RNA, 22 nt, Artificial Sequence
  Synthetic construct: hsa-miR-8068
uguuuguuguaaggaucguugu

SEQ ID NO: 3397 - RNA, 22 nt, Artificial Sequence
  Synthetic construct: hsa-miR-8068
aacgauccuuacaacaaacauu

SEQ ID NO: 3398 - RNA, 23 nt, Artificial Sequence
  Synthetic construct: hsa-miR-8069
ggaugguugggggcggucggcgu

SEQ ID NO: 3399 - RNA, 23 nt, Artificial Sequence
  Synthetic construct: hsa-miR-8069
gccgaccgcccccaaccauccuu

SEQ ID NO: 3400 - RNA, 22 nt, Artificial Sequence
  Synthetic construct: hsa-miR-8070
augugauugacggcugacucca

SEQ ID NO: 3401 - RNA, 22 nt, Artificial Sequence
  Synthetic construct: hsa-miR-8070
gagucagccgucaaucacauuu

SEQ ID NO: 3402 - RNA, 20 nt, Artificial Sequence
  Synthetic construct: hsa-miR-8071
cgguggacuggagugggugg

SEQ ID NO: 3403 - RNA, 20 nt, Artificial Sequence
  Synthetic construct: hsa-miR-8071
acccacuccaguccaccguu

SEQ ID NO: 3404 - RNA, 20 nt, Artificial Sequence
  Synthetic construct: hsa-miR-8072
ggcggcggggagguaggcag

SEQ ID NO: 3405 - RNA, 20 nt, Artificial Sequence
  Synthetic construct: hsa-miR-8072
gccuaccuccccgccgccuu

SEQ ID NO: 3406 - RNA, 22 nt, Artificial Sequence
  Synthetic construct: hsa-miR-8073
accuggcagcagggagcgucgu

SEQ ID NO: 3407 - RNA, 22 nt, Artificial Sequence
  Synthetic construct: hsa-miR-8073
gacgcucccugcugccagguuu

SEQ ID NO: 3408 - RNA, 24 nt, Artificial Sequence
  Synthetic construct: hsa-miR-8074
cuauggcgagacuggcauguacuc

SEQ ID NO: 3409 - RNA, 24 nt, Artificial Sequence
  Synthetic construct: hsa-miR-8074
guacaugccagucucgccauaguu

SEQ ID NO: 3410 - RNA, 24 nt, Artificial Sequence
  Synthetic construct: hsa-miR-8075
ugcugauggcagaugucgggucug

SEQ ID NO: 3411 - RNA, 24 nt, Artificial Sequence
  Synthetic construct: hsa-miR-8075
gacccgacaucugccaucagcauu

SEQ ID NO: 3412 - RNA, 24 nt, Artificial Sequence
  Synthetic construct: hsa-miR-8076
uauauggacuuuucugauacaaug

SEQ ID NO: 3413 - RNA, 24 nt, Artificial Sequence
  Synthetic construct: hsa-miR-8076
uuguaucagaaaaguccauauauu

SEQ ID NO: 3414 - RNA, 22 nt, Artificial Sequence
  Synthetic construct: hsa-miR-8077
ggcugagugggguucugacucc

SEQ ID NO: 3415 - RNA, 22 nt, Artificial Sequence
  Synthetic construct: hsa-miR-8077
agucagaaccccacucagccuu

SEQ ID NO: 3416 - RNA, 23 nt, Artificial Sequence
  Synthetic construct: hsa-miR-8078
ggucuaggcccggugagagacuc

SEQ ID NO: 3417 - RNA, 23 nt, Artificial Sequence
  Synthetic construct: hsa-miR-8078
gucucucaccgggccuagaccuu

SEQ ID NO: 3418 - RNA, 20 nt, Artificial Sequence
  Synthetic construct: hsa-miR-8079
cagugaucgucucugcuggc

SEQ ID NO: 3419 - RNA, 20 nt, Artificial Sequence
  Synthetic construct: hsa-miR-8079
cagcagagacgaucacuguu

SEQ ID NO: 3420 - RNA, 23 nt, Artificial Sequence
  Synthetic construct: hsa-miR-8080
gaaggacacuggugucaacggcu

SEQ ID NO: 3421 - RNA, 23 nt, Artificial Sequence
  Synthetic construct: hsa-miR-8080
ccguugacaccaguguccuucuu

SEQ ID NO: 3422 - RNA, 23 nt, Artificial Sequence
  Synthetic construct: hsa-miR-8081
cuugagucgugccuuucugaaug

SEQ ID NO: 3423 - RNA, 23 nt, Artificial Sequence
  Synthetic construct: hsa-miR-8081
uucagaaaggcacgacucaaguu

SEQ ID NO: 3424 - RNA, 22 nt, Artificial Sequence
  Synthetic construct: hsa-miR-8082
ugauggagcugggaauacucug

SEQ ID NO: 3425 - RNA, 22 nt, Artificial Sequence
  Synthetic construct: hsa-miR-8082
gaguauucccagcuccaucauu

SEQ ID NO: 3426 - RNA, 21 nt, Artificial Sequence
  Synthetic construct: hsa-miR-8083
caggacuugacggcugcaacu

SEQ ID NO: 3427 - RNA, 21 nt, Artificial Sequence
  Synthetic construct: hsa-miR-8083
uugcagccgucaaguccuguu

SEQ ID NO: 3428 - RNA, 23 nt, Artificial Sequence
  Synthetic construct: hsa-miR-8084
gaauacuaaguaaaaaaucagua

SEQ ID NO: 3429 - RNA, 23 nt, Artificial Sequence
  Synthetic construct: hsa-miR-8084
cugauuuuuuacuuaguauucuu

SEQ ID NO: 3430 - RNA, 21 nt, Artificial Sequence
  Synthetic construct: hsa-miR-8085
ugggagagaggacugugaggc

SEQ ID NO: 3431 - RNA, 21 nt, Artificial Sequence
  Synthetic construct: hsa-miR-8085
cucacaguccucucucccauu

SEQ ID NO: 3432 - RNA, 22 nt, Artificial Sequence
  Synthetic construct: hsa-miR-8086
ugcuagucuggacugauauggu

SEQ ID NO: 3433 - RNA, 22 nt, Artificial Sequence
  Synthetic construct: hsa-miR-8086
cauaucaguccagacuagcauu

SEQ ID NO: 3434 - RNA, 23 nt, Artificial Sequence
  Synthetic construct: hsa-miR-8087
gaagacuucuuggauuacagggg

SEQ ID NO: 3435 - RNA, 23 nt, Artificial Sequence
  Synthetic construct: hsa-miR-8087
ccuguaauccaagaagucuucuu

SEQ ID NO: 3436 - RNA, 21 nt, Artificial Sequence
  Synthetic construct: hsa-miR-8088
ccucgguacuggaaaggggua

SEQ ID NO: 3437 - RNA, 21 nt, Artificial Sequence
  Synthetic construct: hsa-miR-8088
ccccuuuccaguaccgagguu

SEQ ID NO: 3438 - RNA, 24 nt, Artificial Sequence
  Synthetic construct: hsa-miR-8089
ccuggggacaggggauuggggcag

SEQ ID NO: 3439 - RNA, 24 nt, Artificial Sequence
  Synthetic construct: hsa-miR-8089
gccccaauccccuguccccagguu

SEQ ID NO: 3440 - RNA, 21 nt, Artificial Sequence
  Synthetic construct: hsa-miR-8485
cacacacacacacacacguau

SEQ ID NO: 3441 - RNA, 21 nt, Artificial Sequence
  Synthetic construct: hsa-miR-8485
acguguguguguguguguguu

SEQ ID NO: 3442 - RNA, 21 nt, Artificial Sequence
  Synthetic construct: hsa-miR-873
gcaggaacuugugagucuccu

SEQ ID NO: 3443 - RNA, 22 nt, Artificial Sequence
  Synthetic construct: hsa-miR-873
ggagacugaugaguucccggga

SEQ ID NO: 3444 - RNA, 23 nt, Artificial Sequence
  Synthetic construct: hsa-miR-874
cggccccacgcaccaggguaaga

SEQ ID NO: 3445 - RNA, 22 nt, Artificial Sequence
  Synthetic construct: hsa-miR-874
cugcccuggcccgagggaccga

SEQ ID NO: 3446 - RNA, 22 nt, Artificial Sequence
  Synthetic construct: hsa-miR-875
uauaccucaguuuuaucaggug

SEQ ID NO: 3447 - RNA, 21 nt, Artificial Sequence
  Synthetic construct: hsa-miR-875
ccuggaaacacugagguugug

SEQ ID NO: 3448 - RNA, 22 nt, Artificial Sequence
  Synthetic construct: hsa-miR-876
uggauuucuuugugaaucacca

SEQ ID NO: 3449 - RNA, 22 nt, Artificial Sequence
  Synthetic construct: hsa-miR-876
uggugguuuacaaaguaauuca

SEQ ID NO: 3450 - RNA, 21 nt, Artificial Sequence
  Synthetic construct: hsa-miR-877
uccucuucucccuccucccag

SEQ ID NO: 3451 - RNA, 20 nt, Artificial Sequence
  Synthetic construct: hsa-miR-877
guagaggagauggcgcaggg

SEQ ID NO: 3452 - RNA, 22 nt, Artificial Sequence
  Synthetic construct: hsa-miR-885
uccauuacacuacccugccucu

SEQ ID NO: 3453 - RNA, 22 nt, Artificial Sequence
  Synthetic construct: hsa-miR-885
aggcagcgggguguaguggaua

SEQ ID NO: 3454 - RNA, 21 nt, Artificial Sequence
  Synthetic construct: hsa-miR-887
cuugggagcccuguuagacuc

SEQ ID NO: 3455 - RNA, 22 nt, Artificial Sequence
  Synthetic construct: hsa-miR-887
gugaacgggcgccaucccgagg

SEQ ID NO: 3456 - RNA, 21 nt, Artificial Sequence
  Synthetic construct: hsa-miR-888
uacucaaaaagcugucaguca

SEQ ID NO: 3457 - RNA, 22 nt, Artificial Sequence
  Synthetic construct: hsa-miR-888
gacugacaccucuuugggugaa

SEQ ID NO: 3458 - RNA, 22 nt, Artificial Sequence
  Synthetic construct: hsa-miR-889
aauggcuguccguaguaugguc

SEQ ID NO: 3459 - RNA, 21 nt, Artificial Sequence
  Synthetic construct: hsa-miR-889
uuaauaucggacaaccauugu

SEQ ID NO: 3460 - RNA, 21 nt, Artificial Sequence
  Synthetic construct: hsa-miR-890
uacuuggaaaggcaucaguug

SEQ ID NO: 3461 - RNA, 21 nt, Artificial Sequence
  Synthetic construct: hsa-miR-890
acugaugccuuuccaaguauu

SEQ ID NO: 3462 - RNA, 22 nt, Artificial Sequence
  Synthetic construct: hsa-miR-891a
aguggcacauguuuguugugag

SEQ ID NO: 3463 - RNA, 22 nt, Artificial Sequence
  Synthetic construct: hsa-miR-891a
ugcaacgaaccugagccacuga

SEQ ID NO: 3464 - RNA, 22 nt, Artificial Sequence
  Synthetic construct: hsa-miR-891b
ugcaacuuaccugagucauuga

SEQ ID NO: 3465 - RNA, 22 nt, Artificial Sequence
  Synthetic construct: hsa-miR-891b
aaugacucagguaaguugcauu

SEQ ID NO: 3466 - RNA, 21 nt, Artificial Sequence
  Synthetic construct: hsa-miR-892a
cacuguguccuuucugcguag

SEQ ID NO: 3467 - RNA, 21 nt, Artificial Sequence
  Synthetic construct: hsa-miR-892a
acgcagaaaggacacaguguu

SEQ ID NO: 3468 - RNA, 22 nt, Artificial Sequence
  Synthetic construct: hsa-miR-892b
cacuggcuccuuucuggguaga

SEQ ID NO: 3469 - RNA, 22 nt, Artificial Sequence
  Synthetic construct: hsa-miR-892b
uacccagaaaggagccaguguu

SEQ ID NO: 3470 - RNA, 22 nt, Artificial Sequence
  Synthetic construct: hsa-miR-892c
cacuguuuccuuucugagugga

SEQ ID NO: 3471 - RNA, 21 nt, Artificial Sequence
  Synthetic construct: hsa-miR-892c
uauucagaaaggugccaguca

SEQ ID NO: 3472 - RNA, 23 nt, Artificial Sequence
  Synthetic construct: hsa-miR-9
ucuuugguuaucuagcuguauga

SEQ ID NO: 3473 - RNA, 22 nt, Artificial Sequence
  Synthetic construct: hsa-miR-9
auaaagcuagauaaccgaaagu

SEQ ID NO: 3474 - RNA, 20 nt, Artificial Sequence
  Synthetic construct: hsa-miR-920
ggggagcuguggaagcagua

SEQ ID NO: 3475 - RNA, 20 nt, Artificial Sequence
  Synthetic construct: hsa-miR-920
cugcuuccacagcuccccuu

SEQ ID NO: 3476 - RNA, 25 nt, Artificial Sequence
  Synthetic construct: hsa-miR-921
cuagugagggacagaaccaggauuc

SEQ ID NO: 3477 - RNA, 25 nt, Artificial Sequence
  Synthetic construct: hsa-miR-921
auccugguucugucccucacuaguu

SEQ ID NO: 3478 - RNA, 23 nt, Artificial Sequence
  Synthetic construct: hsa-miR-922
gcagcagagaauaggacuacguc

SEQ ID NO: 3479 - RNA, 23 nt, Artificial Sequence
  Synthetic construct: hsa-miR-922
cguaguccuauucucugcugcuu

SEQ ID NO: 3480 - RNA, 20 nt, Artificial Sequence
  Synthetic construct: hsa-miR-924
agagucuugugaugucuugc

SEQ ID NO: 3481 - RNA, 20 nt, Artificial Sequence
  Synthetic construct: hsa-miR-924
aagacaucacaagacucuuu

SEQ ID NO: 3482 - RNA, 22 nt, Artificial Sequence
  Synthetic construct: hsa-miR-92a-1
uauugcacuugucccggccugu

SEQ ID NO: 3483 - RNA, 23 nt, Artificial Sequence
  Synthetic construct: hsa-miR-92a-1
agguugggaucgguugcaaugcu

SEQ ID NO: 3484 - RNA, 22 nt, Artificial Sequence
  Synthetic construct: hsa-miR-92a-2
uauugcacuugucccggccugu

SEQ ID NO: 3485 - RNA, 22 nt, Artificial Sequence
  Synthetic construct: hsa-miR-92a-2
ggguggggauuuguugcauuac

SEQ ID NO: 3486 - RNA, 22 nt, Artificial Sequence
  Synthetic construct: hsa-miR-92b
uauugcacucgucccggccucc

SEQ ID NO: 3487 - RNA, 22 nt, Artificial Sequence
  Synthetic construct: hsa-miR-92b
agggacgggacgcggugcagug

SEQ ID NO: 3488 - RNA, 22 nt, Artificial Sequence
  Synthetic construct: hsa-miR-93
acugcugagcuagcacuucccg

SEQ ID NO: 3489 - RNA, 23 nt, Artificial Sequence
  Synthetic construct: hsa-miR-93
caaagugcuguucgugcagguag

SEQ ID NO: 3490 - RNA, 22 nt, Artificial Sequence
  Synthetic construct: hsa-miR-933
ugugcgcagggagaccucuccc

SEQ ID NO: 3491 - RNA, 22 nt, Artificial Sequence
  Synthetic construct: hsa-miR-933
gagaggucucccugcgcacauu

SEQ ID NO: 3492 - RNA, 22 nt, Artificial Sequence
  Synthetic construct: hsa-miR-934
ugucuacuacuggagacacugg

SEQ ID NO: 3493 - RNA, 22 nt, Artificial Sequence
  Synthetic construct: hsa-miR-934
agugucuccaguaguagacauu

SEQ ID NO: 3494 - RNA, 23 nt, Artificial Sequence
  Synthetic construct: hsa-miR-935
ccaguuaccgcuuccgcuaccgc

SEQ ID NO: 3495 - RNA, 23 nt, Artificial Sequence
  Synthetic construct: hsa-miR-935
gguagcggaagcgguaacugguu

SEQ ID NO: 3496 - RNA, 22 nt, Artificial Sequence
  Synthetic construct: hsa-miR-936
acaguagagggaggaaucgcag

SEQ ID NO: 3497 - RNA, 22 nt, Artificial Sequence
  Synthetic construct: hsa-miR-936
gcgauuccucccucuacuguuu

SEQ ID NO: 3498 - RNA, 22 nt, Artificial Sequence
  Synthetic construct: hsa-miR-937
auccgcgcucugacucucugcc

SEQ ID NO: 3499 - RNA, 20 nt, Artificial Sequence
  Synthetic construct: hsa-miR-937
gugagucaggguggggcugg

SEQ ID NO: 3500 - RNA, 22 nt, Artificial Sequence
  Synthetic construct: hsa-miR-938
ugcccuuaaaggugaacccagu

SEQ ID NO: 3501 - RNA, 22 nt, Artificial Sequence
  Synthetic construct: hsa-miR-938
uggguucaccuuuaagggcauu

SEQ ID NO: 3502 - RNA, 21 nt, Artificial Sequence
  Synthetic construct: hsa-miR-939
cccugggccucugcuccccag

SEQ ID NO: 3503 - RNA, 24 nt, Artificial Sequence
  Synthetic construct: hsa-miR-939
uggggagcugaggcucugggggug

SEQ ID NO: 3504 - RNA, 21 nt, Artificial Sequence
  Synthetic construct: hsa-miR-940
aaggcagggcccccgcucccc

SEQ ID NO: 3505 - RNA, 21 nt, Artificial Sequence
  Synthetic construct: hsa-miR-940
ggagcgggggcccugccuuuu

SEQ ID NO: 3506 - RNA, 23 nt, Artificial Sequence
  Synthetic construct: hsa-miR-941
cacccggcugugugcacaugugc

SEQ ID NO: 3507 - RNA, 23 nt, Artificial Sequence
  Synthetic construct: hsa-miR-941
acaugugcacacagccggguguu

SEQ ID NO: 3508 - RNA, 22 nt, Artificial Sequence
  Synthetic construct: hsa-miR-942
ucuucucuguuuuggccaugug

SEQ ID NO: 3509 - RNA, 22 nt, Artificial Sequence
  Synthetic construct: hsa-miR-942
cacauggccgaaacagagaagu

SEQ ID NO: 3510 - RNA, 21 nt, Artificial Sequence
  Synthetic construct: hsa-miR-943
cugacuguugccguccuccag

SEQ ID NO: 3511 - RNA, 21 nt, Artificial Sequence
  Synthetic construct: hsa-miR-943
ggaggacggcaacagucaguu

SEQ ID NO: 3512 - RNA, 22 nt, Artificial Sequence
  Synthetic construct: hsa-miR-944
aaauuauuguacaucggaugag

SEQ ID NO: 3513 - RNA, 22 nt, Artificial Sequence
  Synthetic construct: hsa-miR-944
cauccgauguacaauaauuuuu

SEQ ID NO: 3514 - RNA, 21 nt, Artificial Sequence
  Synthetic construct: hsa-miR-95
ucaauaaaugucuguugaauu

SEQ ID NO: 3515 - RNA, 22 nt, Artificial Sequence
  Synthetic construct: hsa-miR-95
uucaacggguauuuauugagca

SEQ ID NO: 3516 - RNA, 19 nt, Artificial Sequence
  Synthetic construct: hsa-miR-9500
aagggaagauggugaccac

SEQ ID NO: 3517 - RNA, 19 nt, Artificial Sequence
  Synthetic construct: hsa-miR-9500
ggucaccaucuucccuuuu

SEQ ID NO: 3518 - RNA, 23 nt, Artificial Sequence
  Synthetic construct: hsa-miR-96
uuuggcacuagcacauuuuugcu

SEQ ID NO: 3519 - RNA, 22 nt, Artificial Sequence
  Synthetic construct: hsa-miR-96
aaucaugugcagugccaauaug

SEQ ID NO: 3520 - RNA, 22 nt, Artificial Sequence
  Synthetic construct: hsa-miR-98
cuauacaacuuacuacuuuccc

SEQ ID NO: 3521 - RNA, 22 nt, Artificial Sequence
  Synthetic construct: hsa-miR-98
ugagguaguaaguuguauuguu

SEQ ID NO: 3522 - RNA, 22 nt, Artificial Sequence
  Synthetic construct: hsa-miR-99a
caagcucgcuucuaugggucug

SEQ ID NO: 3523 - RNA, 22 nt, Artificial Sequence
  Synthetic construct: hsa-miR-99a
aacccguagauccgaucuugug

SEQ ID NO: 3524 - RNA, 22 nt, Artificial Sequence
  Synthetic construct: hsa-miR-99b
cacccguagaaccgaccuugcg

SEQ ID NO: 3525 - RNA, 22 nt, Artificial Sequence
  Synthetic construct: hsa-miR-99b
caagcucgugucuguggguccg

The invention claimed is:

1. A method for treating cancer, comprising a step of administering a pharmaceutical composition comprising miR-3670 to a patient/subject in need of cancer treatment, wherein the miR-3670 (i) comprises a double-stranded RNA represented by the nucleotide sequences of SEQ ID NO: 35 and SEQ ID NO: 36 or (ii) consists of a double-stranded RNA represented by the nucleotide sequences of SEQ ID NO: 35 and SEQ ID NO: 67.

2. The method of claim 1, wherein the miR-3670 comprises a double-stranded RNA represented by the nucleotide sequences of SEQ ID NO: 35 and SEQ ID NO: 36.

3. The method of claim 1, wherein the pharmaceutical composition further comprises miR-4477a, wherein the miR-4477a comprises a double-stranded RNA represented by the nucleotide sequences of SEQ ID NO: 43 and SEQ ID NO: 44; or SEQ ID NO: 43 and SEQ ID NO: 68.

4. The method of claim 1, wherein the pharmaceutical composition further comprises miR-8078, wherein the miR-8078 comprises a double-stranded RNA represented by the nucleotide sequences of SEQ ID NO: 65 and SEQ ID NO: 66; or SEQ ID NO: 65 and SEQ ID NO: 69.

5. The method of claim 1, wherein the miRNA induces cancer cell apoptosis to treat said cancer.

6. The method of claim 1, wherein the cancer is one or more cancers selected from the group consisting of: a primary cancer comprising lung cancer, liver cancer, stomach cancer, colorectal cancer, pancreatic cancer, gallbladder and bile duct cancer, breast cancer, leukemia, esophageal cancer, non-Hodgkin lymphoma, thyroid cancer, cervical cancer, or skin cancer; a metastatic carcinoma arising from metastasis to other organs from the primary cancer site of origin; and a neoplastic cell disease caused by the promotion of abnormally excessive cell division.

7. The method of claim 1, wherein the miRNA is a miRNA mimic.

8. The method of claim 7, wherein the miRNA mimic is selected from the group consisting of: one partially including a phosphorothioate structure in which a RNA phosphate backbone structure is substituted with another element; one in which RNA is wholly or partially substituted with DNA, PNA (peptide nucleic acid) or LNA (locked nucleic acid) molecule; and one in which 2' hydroxyl group of RNA sugar is substituted with various functional structures.

9. The method of claim 7, wherein the miRNA mimic consists of a miRNA precursor in the form of pri-miRNA or precursor miRNA; or a miRNA precursor in the form of plasmid.

10. The method of claim 9, wherein the miRNA precursor is selected from the group consisting of: one partially comprising a phosphorothioate structure in which a RNA phosphate backbone structure is substituted with another element; one in which RNA is wholly or partially substituted with DNA, PNA (peptide nucleic acid) or LNA (locked nucleic acid) molecule; and one in which 2' hydroxyl group of RNA sugar is substituted with various functional structures.

11. The method of claim 1, wherein the miR-3670 consists of a double-stranded RNA represented by the nucleotide sequences of SEQ ID NO: 35 and SEQ ID NO: 67.

12. The method of claim 1, wherein the miR-3670 consists of a double-stranded RNA represented by the nucleotide sequences of SEQ ID NO: 35 and SEQ ID NO: 36; or SEQ ID NO: 35 and SEQ ID NO: 67.

13. The method of claim 1, wherein the pharmaceutical composition further comprises miR-8078.

14. The method of claim 1, wherein the pharmaceutical composition further comprises miR-4477a.

15. The method of claim 1, wherein the pharmaceutical composition further comprises at least one of miR-8078 and miR-4477a.

16. The method of claim 1, wherein the pharmaceutical composition further comprises miR-8078 and miR-4477a.

17. The method of claim 8, wherein said another element is sulfur.

18. The method of claim 8, wherein said various functional structures include at least one of methylation, methoxylation, and fluorination.

19. The method of claim 10, wherein said another element is sulfur.

20. The method of claim 10, wherein said various functional structures include at least one of methylation, methoxylation, and fluorination.

* * * * *